US007405074B2

(12) United States Patent
Castle et al.

(10) Patent No.: US 7,405,074 B2
(45) Date of Patent: Jul. 29, 2008

(54) GLYPHOSATE-N-ACETYLTRANSFERASE (GAT) GENES

(75) Inventors: Linda A. Castle, Mountain View, CA (US); Dan Siehl, Menlo Park, CA (US); Lorraine Giver, Sunnyvale, CA (US); Jeremy Minshull, Los Altos, CA (US); Christina Ivy, Encinitas, CA (US); Yong Hong Chen, Foster City, CA (US); Phillip A. Patten, Menlo Park, CA (US); Rebecca Gorton, San Francisco, CA (US); Nicholas B. Duck, Apex, NC (US); Billy Fred McCutchen, Clive, IA (US); Roger Kemble, Wake Forest, NC (US)

(73) Assignees: Pioneer Hi-Bred International, Inc., Des Moines, IA (US); E.I. du Pont de Nemours and Company, Wilmington, DE (US); Verdia Inc., Redwood City, CA (US)

( * ) Notice: Subject to any disclaimer, the term of this patent is extended or adjusted under 35 U.S.C. 154(b) by 164 days.

(21) Appl. No.: 10/835,615

(22) Filed: Apr. 29, 2004

(65) Prior Publication Data
US 2005/0246798 A1 Nov. 3, 2005

(51) Int. Cl.
C12N 9/10 (2006.01)
C12N 15/00 (2006.01)
C12N 5/04 (2006.01)
C12N 15/82 (2006.01)
A01H 5/00 (2006.01)
C12P 21/06 (2006.01)
C07H 21/04 (2006.01)

(52) U.S. Cl. .................. 435/320.1; 435/69.1; 435/193; 435/419; 536/23.2; 536/23.7; 800/278; 800/298; 800/300

(58) Field of Classification Search ........................ None
See application file for complete search history.

(56) References Cited

U.S. PATENT DOCUMENTS

| | | | |
|---|---|---|---|
| 4,535,060 A | 8/1985 | Comai | |
| 4,769,061 A | 9/1988 | Comai | |
| 4,940,835 A | 7/1990 | Shah et al. | |
| 4,971,908 A | 11/1990 | Kishore et al. | |
| 5,145,783 A | 9/1992 | Kishore et al. | |
| 5,188,642 A | 2/1993 | Shah et al. | |
| 5,310,667 A | 5/1994 | Eichholtz et al. | |
| 5,312,910 A | 5/1994 | Kishore et al. | |
| 5,463,175 A | 10/1995 | Barry et al. | |
| 5,491,288 A | 2/1996 | Chaubet et al. | |
| 5,510,471 A | 4/1996 | Lebrun et al. | |
| 5,627,061 A | 5/1997 | Barry et al. | |
| 5,633,435 A | 5/1997 | Barry et al. | |
| 5,633,448 A | 5/1997 | Lebrun et al. | |
| 5,776,760 A | 7/1998 | Barry et al. | |
| 5,804,425 A | 9/1998 | Barry et al. | |
| 5,866,775 A | 2/1999 | Eichholtz et al. | |
| 6,130,366 A | 10/2000 | Herrera-Estrella et al. | |
| 6,225,114 B1 | 5/2001 | Eichholtz et al. | |
| 6,248,876 B1 | 6/2001 | Barry et al. | |
| 6,448,476 B1 | 9/2002 | Barry | |
| 6,500,617 B1 | 12/2002 | Stemmer et al. | |
| 7,018,794 B2 | 3/2006 | Berka et al. | |
| 2002/0146721 A1 | 10/2002 | Berka et al. | |
| 2003/0083480 A1 | 5/2003 | Castle et al. | |
| 2004/0082770 A1* | 4/2004 | Castle et al. ............... | 536/23.2 |
| 2005/0246798 A1 | 11/2005 | Castle et al. | |
| 2006/0191033 A1 | 8/2006 | Castle et al. | |
| 2006/0200874 A1* | 9/2006 | Castle et al. ............... | 800/278 |

FOREIGN PATENT DOCUMENTS

| | | |
|---|---|---|
| WO | WO 97/04103 | 2/1997 |
| WO | WO 00/09727 | 2/2000 |
| WO | WO 00/29596 | 5/2000 |
| WO | WO 00/66746 | 11/2000 |
| WO | WO 00/66747 | 11/2000 |
| WO | WO 01/66704 A2 | 9/2001 |
| WO | WO 01/66704 A3 | 9/2001 |
| WO | WO 02/29113 A2 | 4/2002 |
| WO | WO 02/36782 A2 * | 5/2002 |
| WO | WO 03/092360 A2 | 11/2003 |

OTHER PUBLICATIONS

Whisstock et al., Prediction of protein function from protein sequence and structure. Q. Rev. Biophys., 2003, vol. 36 (3): 307-340.*

(Continued)

*Primary Examiner*—Rebecca E. Prouty
*Assistant Examiner*—Ganapathirama Raghu
(74) *Attorney, Agent, or Firm*—Alston & Bird LLP

(57) ABSTRACT

Novel proteins are provided herein, including proteins capable of catalyzing the acetylation of glyphosate and other structurally related proteins. Also provided are novel polynucleotides capable of encoding these proteins, compositions that include one or more of these novel proteins and/or polynucleotides, recombinant cells and transgenic plants comprising these novel compounds, diversification methods involving the novel compounds, and methods of using the compounds. Some of the novel methods and compounds provided herein can be used to render an organism, such as a plant, resistant to glyphosate.

16 Claims, 21 Drawing Sheets

OTHER PUBLICATIONS

ExPasy Sequence alignment of Seq ID No. 445 and Seq ID No. 584. One page.*

Aono, M., et al. "Paraquat Tolerance of Transgenic *Nicotiana tabacum* with Enhanced Activities of Gluthaione Reductase and Superoxide Dismutase" *Plant Cell Physiol.*, 1995, p. 1687, vol. 36.

Database EMBL Online Jul. 1, 1997, Kunst et al., YIII protein Database Accession No. 006744 [Abstract].

Datta, S., et al., "Herbicide-Resistant Indica Rice Plants from IRRI Breeding Line IR72 after PEG-Mediated Transformation of Protoplasts," *Plant Mol. Biol.*, 1992, p. 619, vol. 20.

Hattori, J., et al., "An Acetohydroxy Acid Synthase Mutant Reveals a Single Site Involved in Multiple Herbicide Resistance," *Mol. Gen. Genet.*, 1995, p. 419, vol. 246.

Kunst, F., et al., "The Complete Genome Sequence of the Gram-positive bacterium *Bacillus subtilis*," *Nature*, Nov. 1997, pp. 249-266, vol. 290.

Padgette, et al., "New weed control opportunities: Development of Soybeans with a Round UP Ready™," *Herbicide-Resistant Crops*, 1996, pp. 54-84.

Roche, B., et al., "A *Bacillus subtilis* chromosome segment at the 100° to 102° Position Encoding 11 Membrane Proteins," *Microbiology*, 1997, pp. 3309-3312, vol. 143.

Shiota, N., et al., "Herbicide-Resistant Tobacco Plants Expressing the Fused Enzyme between Rat Cytochrome P4501A1 (CYP1A1) and Yeast NADPH-Cytochrome P450 Oxidoreducatase," *Plant Physiol.*, 1994, p. 17, vol. 106.

Vasil, "Phosphinothriein-Resistant Crops," *Herbicide-Resistant Crops*, 1996, pp. 85-91, Duke, ed., CRC Press, Boca Raton.

Kunst, F., et al., "The Complete Genome Sequence of the Gram-positive Bacterium *Bacillus subtilis*," *Nature*, Nov. 1997, pp. 249-256, vol. 390.

Kunst, F., et al., 1997, "Hypothetical protein BSU11000 [*Bacillus subtilis* subsp. *subtilis* str. 168," Genbank Accession No. NP_388981.

Castle, L.A. et al., "Discovery and Directed Evolution of a Glyphosate Tolerance Gene," *Science*, May 21, 2004, pp. 1151-1154, vol. 304.

Rey, M.W., et al., "Complete Genome Sequence of the Industrial Bacterium *Bacillus licheniformis* and Comparisons with Closely Related *Bacillus* Species," *Genome Biology*, Sep. 13, 2004, R77, vol. 5.

Broun, P, et al., "Catalytic Plasticity of Fatty Acid Modification Enzymes Underlying Chemical Diversity of Plant Lipids",*Science*, vol. 282, Nov. 13, 1998, pp. 1315-1317.

Guo, H.H., et al., "Protein Tolerance to Random Amino Acid Change",*PNAS*, vol. 101, No. 25, Jun. 22, 2004, pp. 9205-9210.

Seffernick, J.L., et al., "Melamine Deaminase and Atrazine Chlorohydrolase: 98 Percent Identical but Functionally Different,",*Journal of Bacteriology*, vol. 183, No. 8, Apr. 2001, pp. 2405-2410.

Witkowski, A., et al., "Conversion of αβ-Ketoacyl Synthase to a Malonyl Decarboxylase by Replacement of the Active-Site Cysteine with Glutamine",*Biochemistry*, vol. 38, 1999, pp. 11643-11650.

NCBI Report for Accession No. CAA70664, Direct Submission Nov. 14, 1996.

* cited by examiner

Nucleotide identity between sequence pairs

| | B6 | DS3 | ST401 | NHA-2 | NH5-2 | yitl |
|---|---|---|---|---|---|---|
| B6 | **** | 95.0 | 93.2 | 94.8 | 92.8 | 62.0 |
| DS3 | | **** | 95.5 | 99.8 | 95.0 | 61.8 |
| ST401 | | | **** | 95.2 | 99.5 | 62.4 |
| NHA-2 | | | | **** | 94.8 | 61.5 |
| NH5-2 | | | | | **** | 62.9 |
| yitl | | | | | | **** |

Fig. 3

Purified B6 GAT catalyzes N-acetylglyphosate production

B6 GAT $K_M$ for Acetyl CoA = 2 μM

B6 GAT $K_M$ for glyphosate = 2.9 mM

US 7,405,074 B2

GLYPHOSATE-N-ACETYLTRANSFERASE (GAT) GENES

COPYRIGHT NOTIFICATION PURSUANT TO 37 C.F.R. § 1.71(E)

A portion of the disclosure of this patent document contains material which is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

BACKGROUND OF THE INVENTION

Crop selectivity to specific herbicides can be conferred by engineering genes into crops which encode appropriate herbicide metabolizing enzymes. In some cases these enzymes, and the nucleic acids that encode them, originate in a plant. In other cases, they are derived from other organisms, such as microbes. See, e.g., Padgette et al. (1996) "New weed control opportunities: Development of soybeans with a Round UP Ready™ gene" and Vasil (1996) "Phosphinothricin-resistant crops", both in *Herbicide-Resistant Crops*, ed. Duke (CRC Press, Boca Raton, Fla.) pp. 54-84 and pp. 85-91. Indeed, transgenic plants have been engineered to express a variety of herbicide tolerance/metabolizing genes, from a variety of organisms. For example, acetohydroxy acid synthase, which has been found to make plants that express this enzyme resistant to multiple types of herbicides, has been introduced into a variety of plants (see, e.g., Hattori et al. (1995) *Mol. Gen. Genet.* 246: 419). Other genes that confer tolerance to herbicides include: a gene encoding a chimeric protein of rat cytochrome P4507A1 and yeast NADPH-cytochrome P450 oxidoreductase (Shiota et al. (1994) *Plant Physiol.* 106: 17), genes for glutathione reductase and superoxide dismutase (Aono et al. (1995) *Plant Cell Physiol.* 36: 1687, and genes for various phosphotransferases (Datta et al. (1992) *Plant Mol. Biol.* 20: 619).

One herbicide which is the subject of much investigation in this regard is N-phosphonomethylglycine, commonly referred to as glyphosate. Glyphosate is the top selling herbicide in the world, with sales projected to reach $5 billion by 2003. It is a broad spectrum herbicide that kills both broadleaf and grass-type plants. A successful mode of commercial level glyphosate resistance in transgenic plants is by introduction of a modified *Agrobacterium* CP4 5-enolpyruvylshikimate-3-phosphate synthase (hereinafter referred to as EPSP synthase or EPSPS) gene. The transgene is targeted to the chloroplast where it is capable of continuing to synthesize EPSP from phosphoenolpyruvic acid (PEP) and shikimate-3-phosphate in the presence of glyphosate. In contrast, the native EPSP synthase is inhibited by glyphosate. Without the transgene, plants sprayed with glyphosate quickly die due to inhibition of EPSP synthase which halts the downstream pathway needed for aromatic amino acid, hormone, and vitamin biosynthesis. The CP4 glyphosate-resistant soybean transgenic plants are marketed, e.g., by Monsanto under the name "Round UP Ready™."

In the environment, the predominant mechanism by which glyphosate is degraded is through soil microflora metabolism. The primary metabolite of glyphosate in soil has been identified as aminomethylphosphonic acid (AMPA), which is ultimately converted into ammonia, phosphate and carbon dioxide. The proposed metabolic scheme that describes the degradation of glyphosate in soil through the AMPA pathway is shown in FIG. 8. An alternative metabolic pathway for the breakdown of glyphosate by certain soil bacteria, the sarcosine pathway, occurs via initial cleavage of the C—P bond to give inorganic phosphate and sarcosine, as depicted in FIG. 9.

Another successful herbicide/transgenic crop package is glufosinate (phosphinothricin) and the Liberty Link™ trait marketed, e.g., by Aventis. Glufosinate is also a broad spectrum herbicide. Its target is the glutamate synthase enzyme of the chloroplast. Resistant plants carry the bar gene from *Streptomyces hygroscopicus* and achieve resistance by the N-acetylation activity of bar, which modifies and detoxifies glufosinate.

An enzyme capable of acetylating the primary amine of AMPA is reported in PCT Application No. WO00/29596. The enzyme was not described as being able to acetylate a compound with a secondary amine (e.g., glyphosate).

While a variety of herbicide resistance strategies are available as noted above, additional approaches would have considerable commercial value. The present invention provides novel polynucleotides and polypeptides for conferring herbicide tolerance, as well as numerous other benefits as will become apparent during review of the disclosure.

SUMMARY OF THE INVENTION

The present invention provides methods and reagents for rendering an organism, such as a plant, resistant to glyphosate by one or more of the embodiments described below.

One embodiment of the invention provides novel polypeptides referred to herein as glyphosate-N-acetyltransferase ("GAT") polypeptides. GAT polypeptides are characterized by their structural similarity to one another, e.g., in terms of sequence similarity when the GAT polypeptide's are aligned with one another. GAT polypeptides of the present invention possess glyphosate-N-acetyltransferase activity, i.e., the ability to catalyze the acetylation of glyphosate. These GAT polypeptides transfer the acetyl group from acetyl CoA to the N of glyphosate. In addition, some GAT polypeptides transfer the propionyl group of propionyl CoA to the N of glyphosate. Some GAT polypeptides are also capable of catalyzing the acetylation of glyphosate analogs and/or glyphosate metabolites, e.g., aminomethylphosphonic acid. Exemplary GAT polypeptides correspond to SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972.

Also provided are novel polynucleotides referred to herein as GAT polynucleotides, e.g., SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952. GAT polynucleotides are characterized by their ability to encode GAT polypeptides. In some embodiments of the invention, a GAT polynucleotide is engineered for better plant expression by replacing one or more parental codons with a synonymous codon that is preferentially used in plants relative to the parental codon. In other embodiments, a GAT polynucleotide is modified by the introduction of a nucleotide sequence encoding an N-terminal chloroplast transit peptide. In other embodiments, a GAT polynucleotide is modified by the insertion of one or more G+C containing codons (such as GCG or GCT) immediately downstream of and adjacent to the initiating Met codon.

GAT polypeptides, GAT polynucleotides and glyphosate-N-acetyltransferase activity are described in more detail below. The invention further includes certain fragments of the GAT polypeptides and GAT polynucleotides described herein.

The invention includes non-native variants of the polypeptides and polynucleotides described herein, wherein one or more amino acid of the encoded polypeptide has been mutated.

In certain preferred embodiments, the GAT polypeptides of the present invention are characterized as follows. When optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, one or more of the following positions conform to the following restrictions: (i) at positions 18 and 38, a Z5 amino acid residue; (ii) at position 62, a Z1 amino acid residue; (iii) at position 124, a Z6 amino acid residue; and (iv) at position 144, a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P.

The invention further provides an isolated or recombinant polypeptide comprising an amino acid sequence selected from the groups consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:712; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590.

The invention further provides an isolated or recombinant polypeptide comprising an amino acid sequence selected from the groups consisting of: (a) an amino acid sequence that is at least 96% identical to positions 2-146 of SEQ ID NO:919 (such as, for example, SEQ ID NO:917, 919, 921, 923, 925, 927, 833, 835, 839, 843, 845, 859, 863, 873, 877, 891, 895, 901, 905, 907, 913, 915, or 950); (b) an amino acid sequence that is at least 97% identical to positions 2-146 of SEQ ID NO:929 (such as, for example, SEQ ID NO:929, 931, 835, 843, 849, or 867); (c) an amino acid sequence that is at least 98% identical to positions 2-146 of SEQ ID NO:847 (such as, for example, SEQ ID NO:845 or 847); (d) an amino acid sequence that is at least 98% identical to positions 2-146 of SEQ ID NO:851; (e) an amino acid sequence that is at least 98% identical to positions 2-146 of SEQ ID NO:853; (f) an amino acid sequence that is at least 98% identical to positions 2-146 of SEQ ID NO:855 (such as, for example, SEQ ID NO:835 or 855); (g) an amino acid sequence that is at least 98% identical to positions 2-146 of SEQ ID NO:857; (h) an amino acid sequence that is at least 98% identical to positions 2-146 of SEQ ID NO:861 (such as, for example, SEQ ID NO:839, 861, or 883); (i) an amino acid sequence that is at least 98% identical to positions 2-146 of SEQ ID NO:871; (j) an amino acid sequence that is at least 98% identical to positions 2-146 of SEQ ID NO:875; (k) an amino acid sequence that is at least 98% identical to positions 2-146 of SEQ ID NO:881; (l) an amino acid sequence that is at least 98% identical to positions 2-146 of SEQ ID NO:885 (such as, for example, SEQ ID NO:845 or 885); (m) an amino acid sequence that is at least 98% identical to positions 2-146 of SEQ ID NO:887; (n) an amino acid sequence that is at least 98% identical to positions 2-146 of SEQ ID NO:889 (such as, for example, SEQ ID NO: 863, 889, 891, or 903); (o) an amino acid sequence that is at least 98% identical to positions 2-146 of SEQ ID NO:893; (p) an amino acid sequence that is at least 98% identical to positions 2-146 of SEQ ID NO:897; (q) an amino acid sequence that is at least 98% identical to positions 2-146 of SEQ ID NO:899; (r) an amino acid sequence that is at least 98% identical to positions 2-146 of SEQ ID NO:909 (such as, for example, SEQ ID NO:883 or 909); (s) an amino acid sequence that is at least 98% identical to positions 2-146 of SEQ ID NO:911; (t) an amino acid sequence that is at least 99% identical to positions 2-146 of SEQ ID NO:837; (u) an amino acid sequence that is at least 99% identical to positions 2-146 of SEQ ID NO:841; (v) an amino acid sequence that is at least 99% identical to positions 2-146 of SEQ ID NO:865; (w) an amino acid sequence that is at least 99% identical to positions 2-146 of SEQ ID NO:869; and (x) an amino acid sequence that is at least 99% identical to positions 2-146 of SEQ ID NO:879. In some embodiments of the invention, the amino acid sequence of the polypeptide comprises Met, Met-Ala, or Met-Ala-Ala on the N-terminal side of the amino acid corresponding to position 2 of the reference amino acid sequence.

The invention further provides an isolated or recombinant polypeptide comprising an amino acid sequence that is at least 95% identical to positions 2-146 of SEQ ID NO:929 and which comprises a Gly or an Asn residue at the amino acid position corresponding to position 33 of SEQ ID NO:929

(such as, for example, SEQ ID NO:837, 849, 893, 897, 905, 921, 927, 929 or 931). In some embodiments of the invention, the amino acid sequence of the polypeptide comprises Met, Met-Ala, or Met-Ala-Ala on the N-terminal side of the amino acid corresponding to position 2 of the reference amino acid sequence.

The invention further provides a nucleic acid construct comprising a polynucleotide of the invention. The construct can be a vector, such as a plant transformation vector. In some aspects a vector of the invention will comprise a T-DNA sequence. The construct can optionally include a regulatory sequence (e.g., a promoter) operably linked to a GAT polynucleotide, where the promoter is heterologous with respect to the polynucleotide and effective to cause sufficient expression of the encoded polypeptide to enhance the glyphosate tolerance of a plant cell transformed with the nucleic acid construct.

In some aspects of the invention, a GAT polynucleotide functions as a selectable marker, e.g., in a plant, bacteria, actinomycete, yeast, algae or other fungi. For example, an organism that has been transformed with a vector including a GAT polynucleotide selectable marker can be selected based on its ability to grow in the presence of glyphosate. A GAT marker gene can be used for selection or screening for transformed cells expressing the gene.

The invention further provides vectors with stacked traits, i.e., vectors that encode a GAT polypeptide and that also include a second polynucleotide sequence encoding a second polypeptide that confers a detectable phenotypic trait upon a cell or organism expressing the second polypeptide at an effective level, for example disease resistance or pest resistance. The detectable phenotypic trait can also function as a selectable marker, e.g., by conferring herbicide resistance or by providing some sort of visible marker.

In one embodiment, the invention provides a composition comprising two or more polynucleotides of the invention. Preferably, the GAT polynucleotides encode GAT polypeptides having different kinetic parameters, i.e., a GAT variant having a lower K, can be combined with one having a higher at. In a further embodiment, the different GAT polynucleotides may be coupled to a chloroplast transit sequence or other signal sequence thereby providing GAT polypeptide expression in different cellular compartments, organelles or secretion of one or more of the GAT polypeptides.

Accordingly, compositions containing two or more GAT polynucleotides or encoded polypeptides are a feature of the invention. In some cases, these compositions are libraries of nucleic acids containing, e.g., at least 3 or more such nucleic acids. Compositions produced by digesting the nucleic acids of the invention with a restriction endonuclease, a DNAse or an RNAse, or otherwise fragmenting the nucleic acids, e.g., mechanical shearing, chemical cleavage, etc., are also a feature of the invention, as are compositions produced by incubating a nucleic acid of the invention with deoxyribonucleotide triphosphates and a nucleic acid polymerase, such as a thermostable nucleic acid polymerase.

Cells transduced by a vector of the invention, or which otherwise incorporate a nucleic acid of the invention, are an aspect of the invention. In a preferred embodiment, the cells express a polypeptide encoded by the nucleic acid of the invention.

In some embodiments, the cells incorporating the nucleic acids of the invention are plant cells. Transgenic plants, transgenic plant cells, and transgenic plant explants incorporating the nucleic acids of the invention are also a feature of the invention. In some embodiments, the transgenic plants, transgenic plant cells, or transgenic plant explants express an exogenous polypeptide with glyphosate-N-acetyltransferase activity encoded by the nucleic acid of the invention. The invention also provides transgenic seeds produced by the transgenic plants of the invention.

The invention further provides transgenic plants, transgenic plant cells, transgenic plant explants, or transgenic seeds having enhanced tolerance to glyphosate due to the expression of a polypeptide with glyphosate-N-acetyltransferase activity and a polypeptide that imparts glyphosate tolerance by another mechanism, such as a glyphosate-tolerant 5-enolpyruvylshikimate-3-phosphate synthase and/or a glyphosate-tolerant glyphosate oxido-reductase. In a further embodiment, the invention provides transgenic plants or transgenic plant explants having enhanced tolerance to glyphosate, as well as tolerance to an additional herbicide due to the expression of a polypeptide with glyphosate-N-acetyltransferase activity, a polypeptide that imparts glyphosate tolerance by another mechanism, such as a glyphosate-tolerant 5-enolpyruvylshikimate-3-phosphate synthase and/or a glyphosate-tolerant glyphosate oxido-reductase and a polypeptide imparting tolerance to the additional herbicide, such as a mutated hydroxyphenylpyruvatedioxygenase, a sulfonamide-tolerant acetolactate synthase, a sulfonamide-tolerant acetohydroxy acid synthase, an imidazolinone-tolerant acetolactate synthase, an imidazolinone-tolerant acetohydroxy acid synthase, a phosphinothricin acetyltransferase and a mutated protoporphyrinogen oxidase.

The invention also provides transgenic plants, transgenic plant cells, transgenic plant explants, or transgenic seeds having enhanced tolerance to glyphosate, as well as tolerance to an additional herbicide due to the expression of a polypeptide with glyphosate-N-acetyltransferase activity and a polypeptide imparting tolerance to an additional herbicide, such as, a mutated hydroxyphenylpyruvatedioxygenase, a sulfonamide-tolerant acetolactate synthase, a sulfonamide-tolerant acetohydroxy acid synthase, an imidazolinone-tolerant acetolactate synthase, an imidazolinone-tolerant acetohydroxy acid synthase, a phosphinothricin acetyltransferase and a mutated protoporphyrinogen oxidase. The invention also provides transgenic plants, transgenic plant cells, transgenic plant explants, or transgenic seeds having enhanced tolerance to glyphosate as well as additional desirable traits which may be conferred by one or more additional transgenes.

Methods of producing the polypeptides of the invention by introducing the nucleic acids encoding them into cells and then expressing and optionally recovering them from the cells or culture medium are a feature of the invention. In preferred embodiments, the cells expressing the polypeptides of the invention are transgenic plant cells.

Methods of increasing the expression level of a polypeptide of the invention in a plant or plant cell by inserting into the polypeptide coding sequence one or two G/C-rich codons (such as GCG or GCT) immediately adjacent to and downstream of the initiating methionine ATG codon, and/or substituting in the polypeptide coding sequence one or more codons which are less frequently utilized in plants for codons encoding the same amino acid(s) which are more frequently utilized in plants, and introducing the modified coding sequence into a plant or plant cell and expressing the modified coding sequence, are also a feature of the invention.

Polypeptides that are specifically bound by a polyclonal antisera that reacts against an antigen derived from SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972 but not to a naturally occurring related sequence, e.g., such as a peptide represented by a subsequence of those of GenBank accession number CAA70664, as well as antibodies which are produced by administering an antigen derived from any one or more of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972 and/or which bind specifically to such antigens and which do not specifically bind to a naturally occurring polypeptide corresponding to those of GenBank accession number CAA70664, are all features of the invention.

Another aspect of the invention relates to methods of polynucleotide diversification to produce novel GAT polynucleotides and polypeptides by recombining or mutating the nucleic acids of the invention in vitro or in vivo. In an embodiment, the recombination produces at least one library of recombinant GAT polynucleotides. The libraries so produced are embodiments of the invention, as are cells comprising the libraries. Furthermore, methods of producing a modified GAT polynucleotide by mutating a nucleic acid of the invention are embodiments of the invention. Recombinant and mutant GAT polynucleotides and polypeptides produced by the methods of the invention are also embodiments of the invention.

In some aspects of the invention, diversification is achieved by using recursive recombination, which can be accomplished in vitro, in vivo, in silico, or a combination thereof. Some examples of diversification methods described in more detail below are family shuffling methods and synthetic shuffling methods. The invention provides methods for producing a glyphosate-resistant transgenic plant or plant cell that involve transforming a plant or plant cell with a polynucleotide encoding a glyphosate-N-acetyltransferase, and optionally regenerating a transgenic plant from the transformed plant cell. In some aspects the polynucleotide is a GAT polynucleotide, optionally a GAT polynucleotide derived from a bacterial source. In some aspects of the invention, the method can comprise growing the transformed plant or plant cell in a concentration of glyphosate that inhibits the growth of a wild-type plant of the same species without inhibiting the growth of the transformed plant. The method can comprise growing the transformed plant or plant cell or progeny of the plant or plant cell in increasing concentrations of glyphosate and/or in a concentration of glyphosate that is lethal to a wild-type plant or plant cell of the same species. A glyphosate-resistant transgenic plant produced by this method can be propagated, for example by crossing it with a second plant, such that at least some progeny of the cross display glyphosate tolerance.

The invention further provides methods for selectively controlling weeds in a field containing a crop that involve planting the field with crop seeds or plants which are glyphosate-tolerant as a result of being transformed with a gene encoding a glyphosate N-acetyltransferase, and applying to the crop and weeds in the field a sufficient amount of glyphosate to control the weeds without significantly affecting the crop.

The invention further provides methods for controlling weeds in a field and preventing the emergence of glyphosate-resistant weeds in a field containing a crop which involve planting the field with crop seeds or plants that are glyphosate-tolerant as a result of being transformed with a gene encoding a glyphosate-N-acetyltransferase and a gene encoding a polypeptide imparting glyphosate tolerance by another mechanism, such as a glyphosate-tolerant 5-enolpyruvylshikimate-3-phosphate synthase and/or a glyphosate-tolerant glyphosate oxido-reductase and applying to the crop and the weeds in the field a sufficient amount of glyphosate to control the weeds without significantly affecting the crop.

In a further embodiment the invention provides methods for controlling weeds in a field and preventing the emergence of herbicide resistant weeds in a field containing a crop which involve planting the field with crop seeds or plants that are glyphosate-tolerant as a result of being transformed with a gene encoding a glyphosate-N-acetyltransferase, a gene encoding a polypeptide imparting glyphosate tolerance by another mechanism, such as a glyphosate-tolerant 5-enolpyruvylshikimate-3-phosphate synthase and/or a glyphosate-tolerant glyphosate oxido-reductase and a gene encoding a polypeptide imparting tolerance to an additional herbicide, such as a mutated hydroxyphenylpyruvatedioxygenase, a sulfonamide-tolerant acetolactate synthase, a sulfonamide-tolerant acetohydroxy acid synthase, an imidazolinone-tolerant acetolactate synthase, an imidazolinone-tolerant acetohydroxy acid synthase, a phosphinothricin acetyltransferase and a mutated protoporphyrinogen oxidase and applying to the crop and the weeds in the field a sufficient amount of glyphosate and an additional herbicide, such as, a hydroxyphenylpyruvatedioxygenase inhibitor, sulfonamide, imidazolinone, bialaphos, phosphinothricin, azafenidin, butafenacil, sulfosate, glufosinate, and a protox inhibitor to control the weeds without significantly affecting the crop.

The invention further provides methods for controlling weeds in a field and preventing the emergence of herbicide resistant weeds in a field containing a crop which involve planting the field with crop seeds or plants that are glyphosate-tolerant as a result of being transformed with a gene encoding a glyphosate-N-acetyltransferase and a gene encoding a polypeptide imparting tolerance to an additional herbicide, such as a mutated hydroxyphenylpyruvatedioxygenase, a sulfonamide-tolerant acetolactate synthase, a sulfonamide-tolerant acetohydroxy acid synthase, an imidazolinone-tolerant acetolactate synthase, an imidazolinone-tolerant acetohydroxy acid synthase, a phosphinothricin acetyltransferase and a mutated protoporphyrinogen oxidase and applying to the crop and the weeds in the field a sufficient amount of glyphosate and an additional herbicide, such as a hydroxyphenylpyruvatedioxygenase inhibitor, sulfonamide, imidazolinone, bialaphos, phosphinothricin, azafenidin, butafenacil, sulfosate, glufosinate, and a protox inhibitor to control the weeds without significantly affecting the crop.

The invention further provides methods for producing a genetically transformed plant that is tolerant to glyphosate that involve inserting into the genome of a plant cell a recombinant, double-stranded DNA molecule comprising: (i) a promoter which functions in plant cells to cause the production of an RNA sequence; (ii) a structural DNA sequence that causes the production of an RNA sequence which encodes a GAT; and (iii) a 3' non-translated region which functions in plant cells to cause the addition of a stretch of polyadenyl nucleotides to the 3' end of the RNA sequence; where the promoter is heterologous with respect to the structural DNA sequence and adapted to cause sufficient expression of the encoded polypeptide to enhance the glyphosate tolerance of a plant cell transformed with the DNA molecule; obtaining a transformed plant cell; and regenerating from the transformed plant cell a genetically transformed plant which has increased tolerance to glyphosate.

The invention further provides methods for producing a crop that involve growing a crop plant that is glyphosate-tolerant as a result of being transformed with a gene encoding a glyphosate N-acetyltransferase, under conditions such that the crop plant produces a crop; and harvesting a crop from the crop plant. These methods often include applying glyphosate to the crop plant at a concentration effective to control weeds. Exemplary crop plants include cotton, corn, and soybean.

The invention also provides computers, computer readable medium and integrated systems, including databases that are composed of sequence records including character strings corresponding to SEQ ID NO: 1-10, 16, 48, 190, 193, 196, 202, 205, 268, 300, 442, 445, 448, 454, 457, 515-830 and 832-972. Such integrated systems optionally include one or more instruction set for selecting, aligning, translating, reverse-translating or viewing any one or more character strings corresponding to SEQ ID NO: 1-10, 16, 48, 190, 193, 196, 202, 205, 268, 300, 442, 445, 448, 454, 457, 515-830 and 832-972, with each other and/or with any additional nucleic acid or amino acid sequence.

BRIEF DESCRIPTION OF THE FIGURES

FIG. 3 is a table illustrating the relative identity between GAT sequences isolated from different strains of bacteria and yitI from *Bacillus subtilis*.

DETAILED DESCRIPTION OF THE INVENTION

Figure 1:
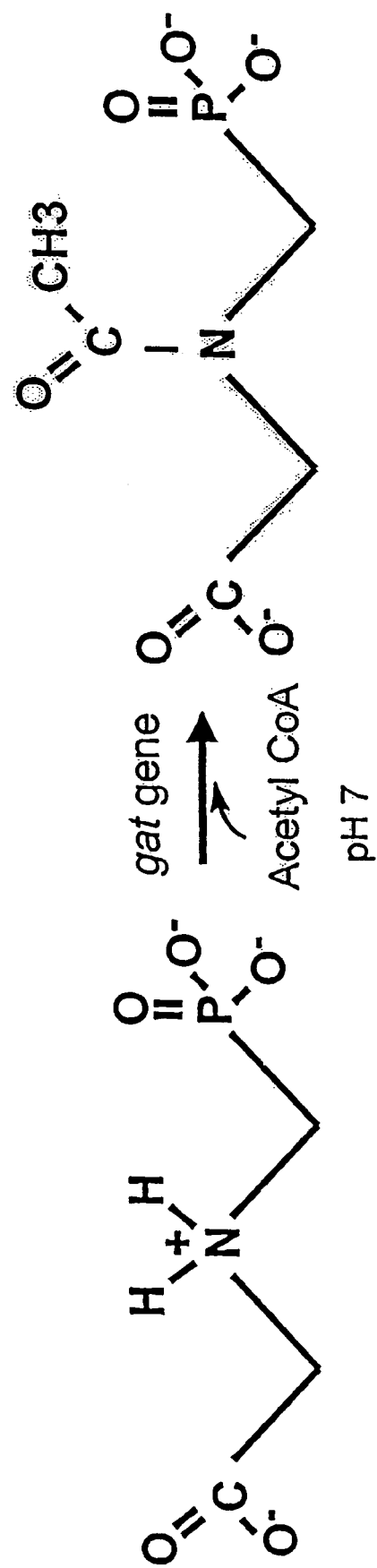
FIG. 1 depicts the N-acetylation of glyphosate catalyzed by a glyphosate-N-acetyltransferase ("GAT").

The present invention relates to a novel class of enzymes exhibiting N-acetyltransferase activity. In one aspect, the invention relates to a novel class of enzymes capable of acetylating glyphosate and glyphosate analogs, e.g., enzymes possessing glyphosate-N-acetyltransferase ("GAT") activity. Such enzymes are characterized by the ability to acetylate the secondary amine of a compound. In some aspects of the invention, this compound is an herbicide, e.g., glyphosate, as illustrated schematically in FIG. 1. This compound can also be a glyphosate analog or a metabolic product of glyphosate degradation, e.g., aminomethylphosphonic acid. Although the acetylation of glyphosate is a key catalytic step in one metabolic pathway for catabolism of glyphosate, the enzymatic acetylation of glyphosate by naturally-occurring, isolated, or recombinant enzymes has not been previously described. Thus, the nucleic acids and polypeptides of the invention provide a new biochemical pathway for engineering herbicide resistance.

In one aspect, the invention provides novel genes encoding GAT polypeptides. Isolated and recombinant GAT polynucleotides corresponding to naturally occurring polynucleotides, as well as recombinant and engineered, e.g., diversified, GAT polynucleotides are a feature of the invention. GAT polynucleotides are exemplified by SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 93.8, 939, 940, 941, 942, 943, 944, 945, 947, 949, 951, and 952. Specific GAT polynucleotide and polypeptide sequences are provided as examples to help illustrate the invention, and are not intended to limit the scope of the genus of GAT polynucleotides and polypeptides described and/or claimed herein.

A CRF copy of the sequence listing entitled "277273 U.S. application sequence listing.txt" has been provided on CD-Rs labeled "copy 1" and "copy 2" on Nov. 29, 2004. This file is 1225 kilobytes in size and was created on Nov. 29, 2004 by reformatting the sequence listing that was submitted with the application as filed; therefore it contains no new matter.

The invention also provides methods for generating and selecting diversified libraries to produce additional GAT polynucleotides, including polynucleotides encoding GAT polypeptides with improved and/or enhanced characteristics, e.g., altered $K_m$ for glyphosate, increased rate of catalysis, increased stability, etc., based upon selection of a polynucleotide constituent of the library for the new or improved activities described herein. Such polynucleotides are especially favorably employed in the production of glyphosate-resistant transgenic plants.

The GAT polypeptides of the invention exhibit a novel enzymatic activity. Specifically, the enzymatic acetylation of the synthetic herbicide glyphosate has not been recognized prior to the present invention. Thus, the polypeptides herein described, e.g., as exemplified by SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 946, 948, 950, 953, 954, 955, 956, 957, 958, 959, 960, 961, 962, 963, 964, 965, 966, 967, 968, 969, 970, 971, and 972 define a novel biochemical pathway for the detoxification of glyphosate that is functional in vivo, e.g., in plants.

Accordingly, the nucleic acids and polypeptides of the invention are of significant utility in the generation of glyphosate-resistant plants by providing new nucleic acids, polypeptides and biochemical pathways for the engineering of herbicide selectivity in transgenic plants.

Definitions

Before describing the present invention in detail, it is to be understood that this invention is not limited to particular compositions or biological systems, which can, of course, vary. It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise. Thus, for example, reference to "a device" includes a combination of two or more such devices, reference to "a gene fusion construct" includes mixtures of constructs, and the like.

Unless defined otherwise, all technical and scientific terms used herein have the same meaning as commonly understood by one of ordinary skill in the art to which the invention pertains. Although any methods and materials similar or equivalent to those described herein can be used in the practice for testing of the present invention, specific examples of appropriate materials and methods are described herein.

In describing and claiming the present invention, the following terminology will be used in accordance with the definitions set out below.

Accordingly, for purposes of the present invention, the term "glyphosate" should be considered to include any herbicidally effective form of N-phosphonomethylglycine (including any salt thereof) and other forms which result in the production of the glyphosate anion in planta. The term "glyphosate analog" refers to any structural analog of glyphosate that has the ability to inhibit EPSPS at levels such that the glyphosate analog is herbicidally effective.

As used herein, the term "glyphosate-N-acetyltransferase activity" or "GAT activity" refers to the ability to catalyze the acetylation of the secondary amine group of glyphosate, as illustrated, for example, in FIG. 1. A "glyphosate-N-acetyltransferase" or "GAT" is an enzyme that catalyzes the acetylation of the amine group of glyphosate, a glyphosate analog, and/or a glyphosate primary metabolite (i.e., AMPA or sarcosine). In some preferred embodiments of the invention, a GAT is able to transfer the acetyl group from Acetyl CoA to the secondary amine of glyphosate and the primary amine of AMPA. In addition, some GATs are also able to transfer the propionyl group of propionyl CoA to glyphosate, indicating that GAT is also an acyltransferase. The exemplary GATs described herein are active from about pH 5-9, with optimal activity in the range of about pH 6.5-8.0. Activity can be quantified using various kinetic parameters which are well known in the art, e.g., $k_{cat}$, $K_M$, and $k_{cat}/K_M$. These kinetic parameters can be determined as described below in Example 7 or Example 19.

The terms "polynucleotide," "nucleotide sequence," and "nucleic acid" are used to refer to a polymer of nucleotides (A, C, T, U, G, etc. or naturally occurring or artificial nucleotide analogues), e.g., DNA or RNA, or a representation thereof, e.g., a character string, etc., depending on the relevant context. A given polynucleotide or complementary polynucleotide can be determined from any specified nucleotide sequence.

Similarly, an "amino acid sequence" is a polymer of amino acids (a protein, polypeptide, etc.) or a character string representing an amino acid polymer, depending on context. The terms "protein," "polypeptide," and "peptide" are used interchangeably herein.

A polynucleotide, polypeptide, or other component is "isolated" when it is partially or completely separated from components with which it is normally associated (other proteins, nucleic acids, cells, synthetic reagents, etc.). A nucleic acid or polypeptide is "recombinant" when it is artificial or engineered, or derived from an artificial or engineered protein or nucleic acid. For example, a polynucleotide that is inserted into a vector or any other heterologous location, e.g., in a genome of a recombinant organism, such that it is not associated with nucleotide sequences that normally flank the polynucleotide as it is found in nature is a recombinant polynucleotide. A protein expressed in vitro or in vivo from a recombinant polynucleotide is an example of a recombinant polypeptide. Likewise, a polynucleotide sequence that does not appear in nature, for example a variant of a naturally occurring gene, is recombinant.

The terms "glyphosate-N-acetyltransferase polypeptide" and "GAT polypeptide" are used interchangeably to refer to any of a family of novel polypeptides provided herein.

The terms "glyphosate-N-acetyltransferase polynucleotide" and "GAT polynucleotide" are used interchangeably to refer to a polynucleotide that encodes a GAT polypeptide.

A "subsequence" or "fragment" is any portion of an entire sequence.

Numbering of an amino acid or nucleotide polymer corresponds to numbering of a selected amino acid polymer or nucleic acid when the position of a given monomer component (amino acid residue, incorporated nucleotide, etc.) of the polymer corresponds to the same residue position in a selected reference polypeptide or polynucleotide.

A vector is a composition for facilitating cell transduction/transformation by a selected nucleic acid, or expression of the nucleic acid in the cell. Vectors include, e.g., plasmids, cosmids, viruses, YACs, bacteria, poly-lysine, chromosome integration vectors, episomal vectors, etc.

"Substantially an entire length of a polynucleotide or amino acid sequence" refers to at least about 70%, generally at least about 80%, or typically about 90% or more of a sequence.

As used herein, an "antibody" refers to a protein comprising one or more polypeptides substantially or partially encoded by immunoglobulin genes or fragments of immunoglobulin genes. The recognized immunoglobulin genes include the kappa, lambda, alpha, gamma, delta, epsilon and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively. A typical immunoglobulin (antibody) structural unit comprises a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain ($V_L$) and variable heavy chain ($V_H$) refer to these light and heavy chains respectively. Antibodies exist as intact immunoglobulins or as a number of well characterized fragments produced by digestion with various peptidases. Thus, for example, pepsin digests an antibody below the disulfide linkages in the hinge region to produce F(ab)'2, a dimer of Fab which itself is a light chain joined to VH-CH1 by a disulfide bond. The F(ab)'2 may be reduced under mild conditions to break the disulfide linkage in the hinge region thereby converting the (Fab')$_2$ dimer into an Fab' monomer. The Fab' monomer is essentially a Fab with part of the hinge region (see, Paul, ed. (1998) *Fundamental Immunology* (4$^{th}$ Edition, Raven Press, NY), for a more detailed description of other antibody fragments). While various antibody fragments are defined in terms of the digestion of an intact antibody, one of skill will appreciate that such Fab' fragments may be synthesized de novo either chemically or by utilizing recombinant DNA methodology. Thus, the term antibody as used herein also includes antibody fragments either produced by the modification of whole antibodies or synthesized de novo using recombinant DNA methodologies. Antibodies include single chain antibodies, including single chain Fv (sFv) antibodies in which a variable heavy and a variable light chain are joined together (directly or through a peptide linker) to form a continuous polypeptide.

A "chloroplast transit peptide" is an amino acid sequence which is translated in conjunction with a protein and directs the protein to the chloroplast or other plastid types present in the cell in which the protein is made. "Chloroplast transit sequence" refers to a nucleotide sequence that encodes a chloroplast transit peptide.

A "signal peptide" is an amino acid sequence which is translated in conjunction with a protein and directs the protein to the secretory system (Chrispeels (1991) *Ann. Rev. Plant Phys. Plant Mol. Biol.* 42: 21-53). If the protein is to be directed to a vacuole, a vacuolar targeting signal can further be added, or if to the endoplasmic reticulum, an endoplasmic reticulum retention signal may be added. If the protein is to be directed to the nucleus, any signal peptide present should be removed and instead a nuclear localization signal included (Raikhel. (1992) *Plant Phys.* 100: 1627-1632).

The terms "diversification" and "diversity," as applied to a polynucleotide, refers to generation of a plurality of modified forms of a parental polynucleotide, or plurality of parental polynucleotides. In the case where the polynucleotide encodes a polypeptide, diversity in the nucleotide sequence of the polynucleotide can result in diversity in the corresponding encoded polypeptide, e.g. a diverse pool of polynucleotides encoding a plurality of polypeptide variants. In some embodiments of the invention, this sequence diversity is exploited by screening/selecting a library of diversified polynucleotides for variants with desirable functional attributes, e.g., a polynucleotide encoding a GAT polypeptide with enhanced functional characteristics.

The term "encoding" refers to the ability of a nucleotide sequence to code for one or more amino acids. The term does not require a start or stop codon. An amino acid sequence can be encoded in any one of six different reading frames provided by a polynucleotide sequence and its complement.

When used herein, the term "artificial variant" refers to a polypeptide having GAT activity, which is encoded by a modified GAT polynucleotide, e.g., a modified form of any one of SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952 or of a naturally occurring GAT polynucleotide isolated from an organism. The modified polynucleotide, from which an artificial variant is produced when expressed in a suitable host, is obtained through human intervention by modification of a GAT polynucleotide.

The term "nucleic acid construct" or "polynucleotide construct" means a nucleic acid molecule, either single-stranded or double-stranded, which is isolated from a naturally occurring gene or which has been modified to contain segments of nucleic acids in a manner that would not otherwise exist in nature. The term nucleic acid construct is synonymous with the term "expression cassette" when the nucleic acid construct contains the control sequences required for expression of a coding sequence of the present invention.

The term "control sequences" is defined herein to include all components, which are necessary or advantageous for the expression of a polypeptide of the present invention. Each control sequence may be native or foreign to the nucleotide sequence encoding the polypeptide. Such control sequences include, but are not limited to, a leader sequence, polyadenylation sequence, propeptide sequence, promoter sequence, signal peptide sequence, and transcription terminator sequence. At a minimum, the control sequences include a promoter and transcriptional and translational stop signals. The control sequences may be provided with linkers for the purpose of introducing specific restriction sites facilitating ligation of the control sequences with the coding region of the nucleotide sequence encoding a polypeptide.

The term "operably linked" is defined herein as a configuration in which a control sequence is appropriately placed at a position relative to the coding sequence of the DNA sequence such that the control sequence directs the expression of a polypeptide.

When used herein the term "coding sequence" is intended to cover a nucleotide sequence, which directly specifies the amino acid sequence of its protein product. The boundaries of the coding sequence are generally determined by an open reading frame, which usually begins with the ATG start codon. The coding sequence typically includes a DNA, cDNA, and/or recombinant nucleotide sequence.

In the present context, the term "expression" includes any step involved in the production of the polypeptide including, but not limited to, transcription, post-transcriptional modification, translation, post-translational modification, and secretion.

In the present context, the term "expression vector" covers a DNA molecule, linear or circular, that comprises a segment encoding a polypeptide of the invention, and which is operably linked to additional segments that provide for its transcription.

The term "host cell", as used herein, includes any cell type which is susceptible to transformation with a nucleic acid construct.

The term "plant" includes whole plants, shoot vegetative organs/structures (e.g., leaves, stems and tubers), roots, flowers and floral organs/structures (e.g., bracts, sepals, petals, stamens, carpels, anthers and ovules), seed (including embryo, endosperm, and seed coat) and fruit (the mature ovary), plant tissue (e.g., vascular tissue, ground tissue, and the like) and cells (e.g., guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous.

The term "heterologous" as used herein describes a relationship between two or more elements which indicates that the elements are not normally found in proximity to one another in nature. Thus, for example, a polynucleotide sequence is "heterologous to" an organism or a second polynucleotide sequence if it originates from a foreign species, or, if from the same species, is modified from its original form. For example, a promoter operably linked to a heterologous coding sequence refers to a coding sequence from a species different from that from which the promoter was derived, or, if from the same species, a coding sequence which is not naturally associated with the promoter (e.g., a genetically engineered coding sequence or an allele from a different ecotype or variety). An example of a heterologous polypeptide is a polypeptide expressed from a recombinant polynucleotide in a transgenic organism. Heterologous polynucleotides and polypeptides are forms of recombinant molecules.

A variety of additional terms are defined or otherwise characterized herein.

Glyphosate-N-Acetyltransferases

In one aspect, the invention provides a novel family of isolated or recombinant enzymes referred to herein as "glyphosate-N-acetyltransferases," "GATs," or "GAT enzymes." GATs are enzymes that have GAT activity, preferably sufficient activity to confer some degree of glyphosate tolerance upon a transgenic plant engineered to express the GAT. Some examples of GATs include GAT polypeptides, described in more detail below.

GAT-mediated glyphosate tolerance is a complex function of GAT activity, GAT expression levels in the transgenic plant, the particular plant, and numerous other factors, including but not limited to the nature and timing of herbicide application. One of skill in the art can determine without undue experimentation the level of GAT activity required to effect glyphosate tolerance in a particular context.

GAT activity can be characterized using the conventional kinetic parameters $k_{cat}$, $K_M$, and $k_{cat}/K_M$. $k_{cat}$ can be thought of as a measure of the rate of acetylation, particularly at high substrate concentrations, $K_M$ is a measure of the affinity of the GAT for its substrates (e.g., acetyl CoA, propionyl CoA and glyphosate), and $k_{cat}/K_M$ is a measure of catalytic efficiency that takes both substrate affinity and catalytic rate into account. $k_{cat}/K_m$ is particularly important in the situation where the concentration of a substrate is at least partially rate-limiting. In general, a GAT with a higher $k_{cat}$ or $k_{cat}/K_M$ is a more efficient catalyst than another GAT with lower $k_{cat}$ or $k_{cat}/K_M$. A GAT with a lower $K_M$ is a more efficient catalyst than another GAT with a higher $K_M$. Thus, to determine whether one GAT is more effective than another, one can compare kinetic parameters for the two enzymes. The relative importance of $k_{cat}$, $k_{cat}/K_M$ and $K_M$ will vary depending upon the context in which the GAT will be expected to function, e.g., the anticipated effective concentration of glyphosate relative to the $K_M$ for glyphosate. GAT activity can also be characterized in terms of any of a number of functional characteristics, including but not limited to stability, susceptibility to inhibition, or activation by other molecules.

Glyphosate-N-Acetyltransferase Polypeptides

In one aspect, the invention provides a novel family of isolated or recombinant polypeptides referred to herein as "glyphosate-N-acetyltransferase polypeptides" or "GAT polypeptides." GAT polypeptides are characterized by their structural similarity to a novel family of GATs. Many but not all GAT polypeptides are GATs. The distinction is that GATs are defined in terms of function, whereas GAT polypeptides are defined in terms of structure. A subset of the GAT polypeptides consists of those GAT polypeptides that have GAT activity, preferably at a level that will function to confer glyphosate resistance upon a transgenic plant expressing the protein at an effective level. Some preferred GAT polypeptides for use in conferring glyphosate tolerance have a $k_{cat}$ of at least 1 $min^{-1}$, or more preferably at least 10 $min^{-1}$, 100 $min^{-1}$ or 1000 $min^{-1}$. Other preferred GAT polypeptides for use in conferring glyphosate tolerance have a $K_M$ no greater than 100 mM, or more preferably no greater than 10 mM, 1 mM, or 0.1 mM. Still other preferred GAT polypeptides for use in conferring glyphosate tolerance have a $k_{cat}/K_M$ of at least 1 mM$^{-1}$min$^{-1}$ or more, preferably at least 10 mM$^{-1}$min$^{-1}$, 100 mM$^{-1}$min$^{-1}$, 1000 mM$^{-1}$min$^{-1}$, or 10,000 mM$^{-1}$min$^{-1}$.

Exemplary GAT polypeptides have been isolated and characterized from a variety of bacterial strains. One example of a monomeric GAT polypeptide that has been isolated and characterized has a molecular radius of approximately 17 kD. An exemplary GAT enzyme isolated from a strain of *B. licheniformis*, SEQ ID NO:7, exhibits a $K_m$ for glyphosate of approximately 2.9 mM and a $K_m$ for acetyl CoA of approximately 2 μM, with a $k_{cat}$ equal to 6/minute.

The term "GAT polypeptide" refers to any polypeptide comprising an amino acid sequence that can be optimally aligned with an amino acid sequence selected from the group consisting of SEQ ID NO:300, 445, and 457 to generate a similarity score of at least 460 using the BLOSUM62 matrix, a gap existence penalty of 11, and a gap extension penalty of 1, wherein at least one of the following positions conform to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P. Some aspects of the invention pertain to GAT polypeptides comprising an amino acid sequence that can be optimally aligned with an amino acid sequence selected from the group consisting of SEQ ID NO: 300, 445, and 457 to generate a similarity score of at least 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, 700, 705, 710, 715, 720, 725, 730, 735, 740, 745, 750, 755, or 760 using the BLOSUM62 matrix, a gap existence penalty of 11, and a gap extension penalty of 1, wherein one or more of the following positions conform to the following restrictions: (i) at positions 18 and 38, a Z5 amino acid residue; (ii) at position 62, a Z1 amino acid residue; (iii) at position 124, a Z6 amino acid residue; and (iv) at position 144, a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P.

Figure 10:
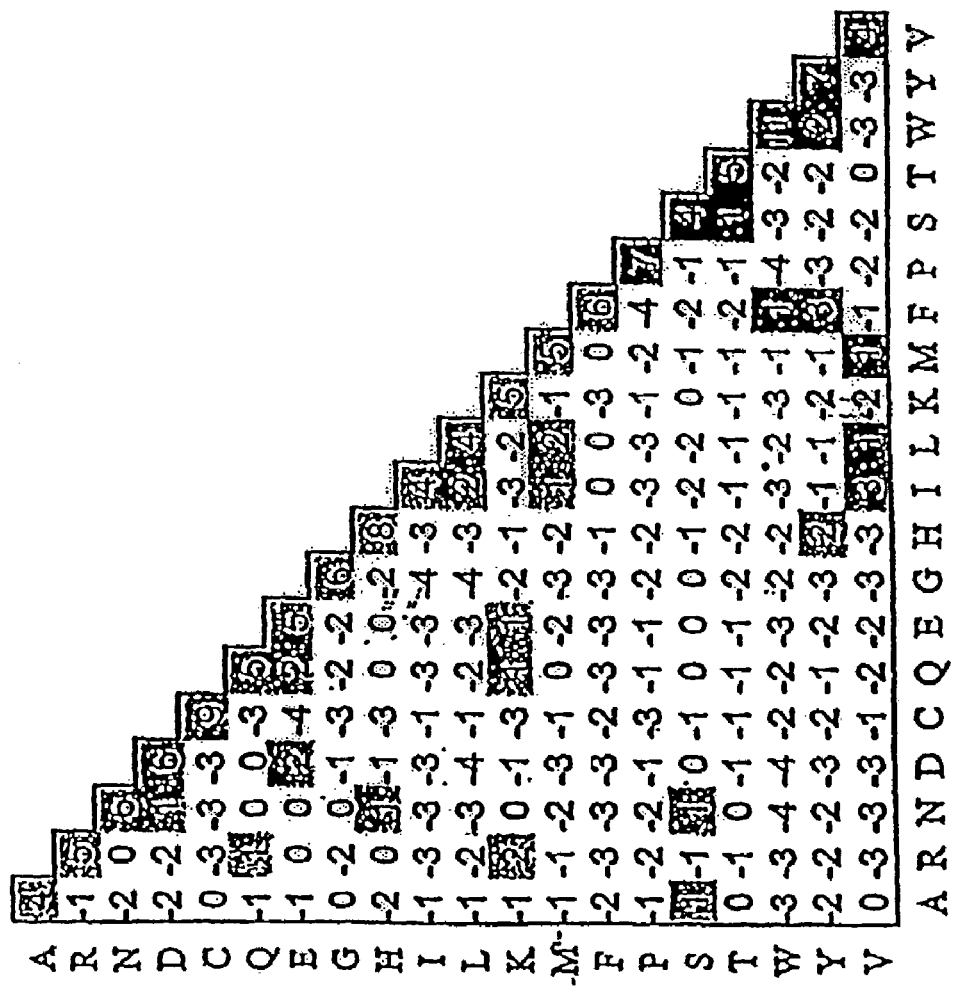
FIG. 10 is the BLOSUM62 matrix.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art and described, e.g., in Dayhoff et al. (1978) "A model of evolutionary change in proteins" in "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) *Proc. Nat'l. Acad. Sci. USA* 89: 10915-10919. The BLOSUM62 matrix (FIG. 10) is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences so as to arrive at the highest possible score. While optimal alignment and scoring can be accomplished manually, the process is facilitated by the use of a computer-implemented alignment algorithm, e.g., gapped BLAST 2.0, described in Altschul et al. (1997) *Nucl. Acids Res.* 25: 3389-3402, and made available to the public at the National Center for Biotechnology Information (NCBI) Website (www.ncbi.nlm.nih.gov). Optimal alignments, including multiple alignments, can be prepared using, e.g., PSI-BLAST, available through the NCB1 website and described by Altschul et al. (1997) *Nucl. Acids Res.* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. For example, in SEQ ID NO:300, position 1 is M, position 2 is I, position 3 is E, etc. When a test sequence is optimally aligned with SEQ ID NO:300, a residue in the test sequence that aligns with the E at position 3 is said to "correspond to position 3" of SEQ ID NO:300. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

The term "GAT polypeptide" further refers to any polypeptide comprising an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590.

The term "GAT polypeptide" further refers to any polypeptide comprising an amino acid sequence having at least 89% sequence identity with residues 1-96 of the amino acid sequence of SEQ ID NO:677; an amino acid sequence having at least 95% sequence identity with residues 1-96 of the amino acid sequence of SEQ ID NO:697; an amino acid sequence having at least 96% sequence identity with residues 1-96 of the amino acid sequence selected from the group consisting of SEQ ID NO:584, 612, and 721; an amino acid sequence having at least 97% sequence identity with residues 1-96 of the amino acid sequence selected from the group consisting of SEQ ID NO:578, 613, and 621; an amino acid sequence having at least 98% sequence identity with residues 1-96 of the amino acid sequence selected from the group consisting of SEQ ID NO:577, 579, 590, 602, 616, and 707.

The term "GAT polypeptide" further refers to any polypeptide comprising an amino acid sequence having at least 89% sequence identity with residues 51-146 of the amino acid sequence of SEQ ID NO:677; an amino acid sequence having at least 95% sequence identity with residues 51-146 of the amino acid sequence of SEQ ID NO:697; an amino acid sequence having at least 96% sequence identity with residues 51-146 of the amino acid sequence selected from the group consisting of SEQ ID NO:584, 612, and 721; an amino acid sequence having at least 97% sequence identity with residues 51-146 of the amino acid sequence selected from the group consisting of SEQ ID NO:578, 613, and 621; an amino acid sequence having at least 98% sequence identity with residues 51-146 of the amino acid sequence selected from the group consisting of SEQ ID NO:577, 579, 590, 602, 616, and 707.

The term "GAT polypeptide" further refers to any polypeptide comprising an amino acid sequence selected from the group consisting of: (a) an amino acid sequence that is at least 96% identical to residues 2-146 of SEQ ID NO:919; (b) an amino acid sequence that is at least 97% identical to residues 2-146 of SEQ ID NO:929; (c) an amino acid sequence that is at least 98% identical to residues 2-146 of SEQ ID NO:847; (d) an amino acid sequence that is at least 98% identical to residues 2-146 of SEQ ID NO:851; (e) an amino acid sequence that is at least 98% identical to residues 2-146 of SEQ ID NO:853; (f) an amino acid sequence that is at least 98% identical to residues 2-146 of SEQ ID NO:855 (such as, for example, SEQ ID NO:835 or 855); (g) an amino acid sequence that is at least 98% identical to residues 2-146 of SEQ ID NO:857; (h) an amino acid sequence that is at least 98% identical to residues 2-146 of SEQ ID NO:861; (i) an amino acid sequence that is at least 98% identical to residues 2-146 of SEQ ID NO:871;0) an amino acid sequence that is at least 98% identical to residues 2-146 of SEQ ID NO:875; (k) an amino acid sequence that is at least 98% identical to residues 2-146 of SEQ ID NO:881; (l) an amino acid sequence that is at least 98% identical to residues 2-146 of SEQ ID NO:885; (m) an amino acid sequence that is at least 98% identical to residues 2-146 of SEQ ID NO:887; (n) an amino acid sequence that is at least 98% identical to residues 2-146 of SEQ ID NO:889; (j) an amino acid sequence that is at least 98% identical to residues 2-146 of SEQ ID NO:893; (p) an amino acid sequence that is at least 98% identical to residues 2-146 of SEQ ID NO:897; (q) an amino acid sequence that is at least 98% identical to residues 2-146 of SEQ ID NO:899; (r) an amino acid sequence that is at least 98% identical to residues 2-146 of SEQ ID NO:909; (s) an amino acid sequence that is at least 98% identical to residues 2-146 of SEQ ID NO:911; (t) an amino acid sequence that is at least 99% identical to residues 2-146 of SEQ ID NO:837; (u) an amino acid sequence that is at least 99% identical to residues 2-146 of SEQ ID NO:841; (v) an amino acid sequence that is at least 99% identical to residues 2-146 of SEQ ID NO:865; (w) an amino acid sequence that is at least 99% identical to residues 2-146 of SEQ ID NO:869; and (x) an amino acid sequence that is at least 99% identical to residues 2-146 of SEQ ID NO:879.

The term "GAT polypeptide" further refers to any polypeptide comprising an amino acid sequence that is at least 95% identical to residues 2-146 of SEQ ID NO:929 and which comprises a Gly or an Asn residue at the amino acid position corresponding to position 33 of SEQ ID NO:929.

The term "GAT polypeptide" further refers to any polypeptide comprising an amino acid sequence that shares at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity with an exemplary GAT polypeptide disclosed herein. Thus, for example, GAT polypeptides of the invention include polypeptides comprising an amino acid sequence that shares at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, or more sequence identity with any of SEQ ID NO: 953, 954, 955, 956, 957, 958, 959, 960, 961, 962, 963, 964, 965, 966, 967, 968, 969, 970, 971, and 972.

As used herein, the term "identity" or "percent identity" when used with respect to a particular pair of aligned amino acid sequences refers to the percent amino acid sequence identity that is obtained by ClustalW analysis (version W 1.8 available from European Bioinformatics Institute, Cambridge, UK), counting the number of identical matches in the alignment and dividing such number of identical matches by the greater of (i) the length of the aligned sequences, and (ii) 96, and using the following default ClustalW parameters to achieve slow/accurate pairwise alignments—Gap Open Penalty: 10; Gap Extension Penalty: 0.10; Protein weight matrix: Gonnet series; DNA weight matrix: IUB; Toggle Slow/Fast pairwise alignments=SLOW or FULL Alignment.

In another aspect, the invention provides an isolated or recombinant polypeptide that comprises at least 20, or alternatively, at least 50, at least 75, at least 100, at least 125, at least 130, at least 135, at least 140, at least 141, at least 142, at least 143, at least 144 or at least 145 contiguous amino acids of an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590.

In another aspect, the invention provides a polypeptide comprising residues 2-146 of an amino acid sequence selected from the group consisting of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, and 825. In some embodiments of the invention, the amino acid sequence of the polypeptide comprises Met, Met-Ala, or Met-Ala-Ala on the N-terminal side of the amino acid corresponding to position 2 of the reference amino acid sequence.

Some preferred GAT polypeptides of the invention can be optimally aligned with a reference amino acid sequence selected from the group consisting of SEQ ID NO:300, 445, and 457 to generate a similarity score of at least 460 using the BLOSUM62 matrix, a gap existence penalty of 11, and a gap extension penalty of 1, wherein at least one of the following positions conforms to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P, and further wherein of the amino acid residues in the amino acid sequence that correspond to the following positions, at least 90% conform to the following restrictions: (a) at positions 2, 4, 15, 19, 26, 28, 31, 45, 51, 54, 86, 90, 91, 97, 103, 105, 106, 114, 123, 129, 139, and/or 145 the amino acid residue is B1; and (b) at positions 3, 5, 8, 10, 11, 14, 17, 24, 27, 32, 37, 47, 48, 49, 52, 57, 58, 61, 63, 68, 69, 79, 80, 82, 83, 89, 92, 100, 101, 104, 119, 120, 125, 126, 128, 131, and/or 143 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T. When used to specify an amino acid or amino acid residue, the single letter designations A, C, D, E, F, G, H, I, K, L, M, N, P, Q, R, S, T, V, W, and Y have their standard meaning as used in the art and as provided in Table 1 herein.

Some preferred GAT polypeptides of the invention can be optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, wherein at least one of the following positions conforms to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P, and further wherein of the amino acid residues in the amino acid sequence that correspond to the following positions, at least 80% conform to the following restrictions: (a) at positions 2, 4, 15, 19, 26, 28, 51, 54, 86, 90, 91, 97, 103, 105, 106, 114, 129, 139, and/or 145 the amino acid residue is Z1; (b) at positions 31 and/or 45 the amino acid residue is Z2; (c) at position 8 the amino acid residue is Z3; (d) at position 89 the amino acid residue is Z3 or Z6; (e) at positions 82, 92, 101 and/or 120 the amino acid residue is Z4; (f) at positions 3, 11, 27 and/or 79 the amino acid residue is Z5; (g) at position 18 the amino acid residue is Z4 or Z5; (h) at position 123 the amino acid residue is Z1 or Z2; (i) at positions 12, 33, 35, 39, 53, 59, 112, 132, 135, 140, and/or 146 the amino acid residue is Z1 or Z3; (j) at position 30 the amino acid residue is Z1; (k) at position 6 the amino acid residue is Z6; (l) at position 81 the amino acid residue is Z2 or Z4; (m) at position 113 the amino acid residue is Z3; (n) at position 138 the amino acid residue is Z4; (j) at position 142 the amino acid residue is Z2; (p) at positions 57 and/or 126 the amino acid residue is Z3 or Z4; (q) at position 5, 17, and 61 the amino acid residue is Z4; (r) at position 24 the amino acid residue is Z3; (s) at position 104 the amino acid residue is Z5; (t) at positions 52, and/or 69 the amino acid residue is Z3; (u) at positions 14 and/or 119 the amino acid residue is Z5; (v) at positions 10, 32, 63, and/or 83 the amino acid residue is Z5; (w) at positions 48 and/or 80 the amino acid residue is Z6; (x) at position 40 the amino acid residue is Z1 or Z2; (y) at position 96 the amino acid residue is Z3 or Z5; (z) at position 65 the amino acid residue is Z3, Z4, or Z6; (aa) at positions 84 and/or 115 the amino acid residue is Z3; (ab) at position 93 the amino acid residue is Z4; (ac) at position 130 the amino acid residue is Z2; (ad) at position 58 the amino acid residue is Z3, Z4 or Z6; (ae) at position 47 the amino acid residue is Z4 or Z6; (af) at positions 49 and/or 100 the amino acid residue is Z3 or Z4; (ag) at position 68 the amino acid residue is Z4 or Z5; (ah) at position 143 the amino acid residue is Z4; (ai) at position 131 the amino acid residue is Z5; (aj) at positions 125 and/or 128 the amino acid residue is Z5; (ak) at position 67 the amino acid residue is Z3 or Z4; (al) at position 60 the amino acid residue is Z5; and (am) at position 37 the amino acid residue is Z4 or Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred GAT polypeptides of the invention further comprise the amino acid residues in the amino acid sequence that correspond to the positions specified in (a)-(am), wherein at least 90% conform to the amino acid residue restrictions specified in (a)-(am).

Some preferred GAT polypeptides of the invention additionally comprise amino acid residues in the amino acid sequence that correspond to the following positions, wherein at least 90% conform to the following restrictions: (a) at positions 1, 7, 9, 13, 20, 36, 42, 46, 50, 56, 64, 70, 72,75,76, 78, 94,98,107,110,117, 118,121, and/or 141 the amino acid residue is B1; and b) at positions 16, 21, 22, 23, 25, 29, 34, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred GAT polypeptides of the invention additionally comprise amino acid residues in the amino acid sequence that correspond to the following positions, wherein at least 90% conform to the following restrictions: (a) at positions 1, 7, 9, 13, 20, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 36, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred GAT polypeptides of the invention additionally comprise amino acid residues in the amino acid sequence that correspond to the following positions, wherein at least 90% conform to the following restrictions: (a) at positions 1, 7, 9, 20, 42, 50, 72, 75, 76, 78, 94, 98, 110, 121, and/or 141 the amino acid residue is Z1; (b) at positions 13, 46, 56, 70, 107, 117, and/or 118 the amino acid residue is Z2; (c) at positions 23, 55, 71, 77, 88, and/or 109 the amino acid residue is Z3; (d) at positions 16, 21, 41, 73, 85, 99, and/or 111 the amino acid residue is Z4; (e) at positions 34 and/or 95 the amino acid residue is Z5; (f) at position 22, 25, 29, 43, 44, 66, 74, 87, 102, 108, 116, 122, 127, 133, 134, 136, and/or 137 the amino acid residue is Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred GAT polypeptides of the invention further comprise an amino acid residue at position 36 which is selected from the group consisting of Z1 and Z3. Some preferred GAT polypeptides of the invention further comprise an amino acid residue at position 64 which is selected from the group consisting of Z1 and Z2.

Some preferred GAT polypeptides of the invention further comprise amino acid residues in the amino acid sequence that correspond to the following positions, wherein at least 80% conform to the following restrictions: (a) at position 2 the amino acid residue is I or L; (b) at position 3 the amino acid residue is E; (c) at position 4 the amino acid residue is V or I; (d) at position 5 the amino acid residue is K; (e) at position 6 the amino acid residue is P; (f) at position 8 the amino acid residue is N; (g) at position 10 the amino acid residue is E; (h) at position 11 the amino acid residue is D or E; (i) at position 12 the amino acid residue is T; (j) at position 14 the amino acid residue is E or D; (k) at position 15 the amino acid residue is L; (l) at position 17 the amino acid residue is H; (m) at position 18 the amino acid residue is R, E or K; (n) at position 19 the amino acid residue is I or V; (o) at position 24 the amino acid residue is Q; (p) at position 26 the amino acid residue is M, L, V or I; (q) at position 27 the amino acid residue is E; (r) at position 28 the amino acid residue is A or V; (s) at position 30 the amino acid residue is M; (t) at position 31 the amino acid residue is Y or F; (u) at position 32 the amino acid residue is E or D; (v) at position 33 the amino acid residue is T or S; (w) at position 35 the amino acid residue is L; (x) at position 37 the amino acid residue is R, G, E or Q; (y) at position 39 the amino acid residue is A or S; (z) at position 40 the amino acid residue is F or L; (aa) at position 45 the amino acid residue is Y or F; (ab) at position 47 the amino acid residue is R or G; (ac) at position 48 the amino acid residue is G; (ad) at position 49 the amino acid residue is K, R, or Q; (ae) at position 51 the amino acid residue is I or V; (af) at position 52 the amino acid residue is S; (ag) at position 53 the amino acid residue is I or V; (ah) at position 54 the amino acid residue is A; (ai) at position 57 the amino acid residue is H or N; (aj) at position 58 the amino acid residue is Q, K, R or P; (ak) at position 59 the amino acid residue is A; (al) at position 60 the amino acid residue is E; (am) at position 61 the amino acid residue is H or R; (an) at position 63 the amino acid residue is E or D; (ao) at position 65 the amino acid residue is E, P or Q; (ap) at position 67 the amino acid residue is Q or R; (aq) at position 68 the amino acid residue is K or E; (ar) at position 69 the amino acid residue is Q; (as) at position 79 the amino acid residue is E; (at) at position 80 the amino acid residue is G; (au) at position 81 the amino acid residue is Y, H or F; (av) at position 82 the amino acid residue is R; (aw) at position 83 the amino acid residue is E or D; (ax) at position 84 the amino acid residue is Q; (ay) at position 86 the amino acid residue is A; (az) at position 89 the amino acid residue is G, T or S; (ba) at position 90 the amino acid residue is L; (bb) at position 91 the amino acid residue is L, I or V; (bc) at position 92 the amino acid residue is R or K; (bd) at position 93 the amino acid residue is H; (be) at position 96 the amino acid residue is E or Q; (bf) at position 97 the amino acid residue is I; (bg) at position 100 the amino acid residue is K or N; (bh) at position 101 the amino acid residue is K or R; (bi) at position 103 the amino acid residue is A or V; (bj) at position 104 the amino acid residue is D; (bk) at position 105 the amino acid residue is M, L or I; (bl) at position 106 the amino acid residue is L; (bm) at position 112 the amino acid residue is T or A; (bn) at position 113 the amino acid residue is S or T; (bo) at position 114 the amino acid residue is A; (bp) at position 115 the amino acid residue is S; (bq) at position 119 the amino acid residue is K or R; (br) at position 120 the amino acid residue is K or R; (bs) at position 123 the amino acid residue is F or L; (bt) at position 125 the amino acid residue is E; (bu) at position 126 the amino acid residue is Q or H; (bv) at position 128 the amino acid residue is E or D; (bw) at position 129 the amino acid residue is V or I; (bx) at position 130 the amino acid residue is F; (by) at position 131 the amino acid residue is D or E; (bx) at position 132 the amino acid residue is T; (ca) at position 135 the amino acid residue is V; (cb) at position 138 the amino acid residue is H; (cc) at position 139 the amino acid residue is I; (cd) at position 140 the amino acid residue is L or M; (ce) at position 142 the amino acid residue is Y; (cf) at position 143 the amino acid residue is K or R; (cg) at position 145 the amino acid residue is L or I; and (ch) at position 146 the amino acid residue is T.

Some preferred GAT polypeptides of the invention further comprise amino acid residues in the amino acid sequence that correspond to the positions specified in (a)-(ch) above, wherein at least 90% conform to the amino acid residue restrictions specified in (a)-(ch).

Some preferred GAT polypeptides of the invention can be optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, wherein at least one of the following positions conforms to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue; wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P, and further wherein of the amino acid residues in the amino acid sequence that correspond to the following positions, at least 80% conform to the following restrictions: (a) at positions 9, 76, 94 and 110 the amino acid residue is A; (b) at positions 29 and 108 the amino acid residue is C; (c) at position 34 the amino acid residue is D; (d) at position 95 the amino acid residue is E; (e) at position 56 the amino acid residue is F; (f) at positions 43, 44, 66, 74, 87, 102, 116, 122, 127 and 136 the amino acid residue is G; (g) at position 41 the amino acid residue is H; (h) at position 7 the amino acid residue is I; (i) at position 85 the amino acid residue is K; (j) at positions 20, 42, 50, 78 and 121 the amino acid residue is L; (k) at positions 1 and 141 the amino acid residue is M; (l) at positions 23 and 109 the amino acid residue is N; (m) at positions 22, 25, 133, 134 and 137 the amino acid residue is P; (n) at position 71 the amino acid residue is Q; (o) at positions 16, 21, 73, 99 and 111 the amino acid residue is R; (p) at position 55 the amino acid residue is S; (q) at position 77 the amino acid residue is T; (r) at position 107 the amino acid residue is W; and (s) at position 13, 46, 70 and 118 the amino acid residue is Y.

Some preferred GAT polypeptides of the invention further comprise amino acid sequences wherein the amino acid residues meet at least one of the following restrictions: (a) at position 36 the amino acid residue is M, L, or T; (b) at position 72 the amino acid residue is L or I; (c) at position 75 the amino acid residue is M or V; (d) at position 64 the amino acid residue is L, I, or F; (e) at position 88 the amino acid residue is T or S; and (f) at position 117 the amino acid residue is Y or F.

Some preferred GAT polypeptides of the invention comprise an amino acid sequence wherein the amino acid residues meet at least one of the following additional restrictions: (a) at position 14 the amino acid residue is D; (b) at position 18 the amino acid residue is E; (c) at position 26 the amino acid residue is M or V; (e) at position 30 the amino acid residue is I; (f) at position 32 the amino acid residue is D; (g) at position 36 the amino acid residue is M or T; (i) at position 37 the amino acid residue is C; (j) at position 38 the amino acid residue is D; (o) at position 53 the amino acid residue is V; (k) at position 58 the amino acid residue is R; (l) at position 61 the amino acid residue is R; (m) at position 62 the amino acid residue is L; (n) at position 64 the amino acid residue is I or F; (o) at position 65 the amino acid residue is P; (p) at position 72 the amino acid residue is I; (q) at position 75 the amino acid residue is V; (r) at position 88 the amino acid residue is T; (s) at position 89 the amino acid residue is G; (t) at position 91 the amino acid residue is L; (u) at position 98 the amino acid residue is I; (v) at position 105 the amino acid residue is I; (w) at position 112 the amino acid residue is A; (x) at position 124 the amino acid residue is G or C; (y) at position 128 the amino acid residue is D; (z) at position 140 the amino acid residue is M; (aa) at position 143 the amino acid residue is R; and (ab) at position 144 the amino acid residue is W.

Some preferred GAT polypeptides of the invention comprise an amino acid sequence wherein of the amino acid residues that correspond to the positions specified in (a) through (ab) as described above, at least 80% conform to the amino acid residue restrictions specified in (a) through (ab).

Some preferred GAT polypeptides of the invention have an amino acid sequence that comprises amino acid residues at least one of which meets the following additional restrictions: (a) at position 41 the amino acid residue is H; (b) at position 138 the amino acid residue is H; (c) at position 34 the amino acid residue is N; and (d) at position 55 the amino acid residue is S.

Some preferred GAT polypeptides of the invention comprise an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590.

Some preferred GAT polypeptides of the invention comprise an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590, wherein at least one of the following positions further conforms to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P.

Some preferred GAT polypeptides of the invention comprise an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590, wherein of the amino acid residues in the amino acid sequence that correspond to the following positions, at least 90% conform to the following additional restrictions: (a) at positions 2, 4, 15, 19, 26, 28, 31, 45, 51, 54, 86, 90, 91, 97, 103, 105, 106, 114, 123, 129, 139, and/or 145 the amino acid residue is B1; and (b) at positions 3, 5, 8, 10, 11, 14, 17, 24, 27, 32, 37, 47, 48, 49, 52, 57, 58, 61, 63, 68, 69, 79, 80, 82, 83, 89, 92, 100, 101, 104, 119, 120, 125, 126, 128, 131, and/or 143 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred GAT polypeptides of the invention comprise an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590, wherein of the amino acid residues in the amino acid sequence that correspond to the following positions, at least 80% conform to the following additional restrictions: (a) at positions 2, 4, 15, 19, 26, 28, 51, 54, 86, 90, 91, 97, 103, 105, 106, 114, 129, 139, and/or 145 the amino acid residue is Z1; (b) at positions 31 and/or 45 the amino acid residue is Z2; (c) at position 8 the amino acid residue is Z3; (d) at position 89 the amino acid residue is Z3 or Z6; (e) at positions 82, 92, 101 and/or 120 the amino acid residue is Z4; (f) at positions 3, 11, 27 and/or 79 the amino acid residue is Z5; (g) at position 18 the amino acid residue is Z4 or Z5; (h) at position 123 the amino acid residue is Z1 or Z2; (i) at positions 12, 33, 35, 39, 53, 59, 112, 132, 135, 140, and/or 146 the amino acid residue is Z1 or Z3; (j) at position 30 the amino acid residue is Z1; (k) at position 6 the amino acid residue is Z6; (l) at position 81 the amino acid residue is Z2 or Z4; (m) at position 113 the amino acid residue is Z3; (n) at position 138 the amino acid residue is Z4; (o) at position 142 the amino acid residue is Z2; (p) at positions 57 and/or 126 the amino acid residue is Z3 or Z4; (q) at position 5, 17, and 61 the amino acid residue is Z4; (r) at position 24 the amino acid residue is Z3; (s) at position 104 the amino acid residue is Z5; (t) at positions 52, and/or 69 the amino acid residue is Z3; (u) at positions 14 and/or 119 the amino acid residue is Z5; (v) at positions 10, 32, 63, and/or 83 the amino acid residue is Z5; (w) at positions 48 and/or 80 the amino acid residue is Z6; (x) at position 40 the amino acid residue is Z1 or Z2; (y) at position 96 the amino acid residue is Z3 or Z5; (z) at position 65 the amino acid residue is Z3, Z4, or Z6; (aa) at positions 84 and/or 115 the amino acid residue is Z3; (ab) at position 93 the amino acid residue is Z4; (ac) at position 130 the amino acid residue is Z2; (ad) at position 58 the amino acid residue is Z3, Z4 or Z6; (ae) at position 47 the amino acid residue is Z4 or Z6; (af) at positions 49 and/or 100 the amino acid residue is Z3 or Z4; (ag) at position 68 the amino acid residue is Z4 or Z5; (ah) at position 143 the amino acid residue is Z4; (ai) at position 131 the amino acid residue is Z5; (aj) at positions 125 and/or 128 the amino acid residue is Z5; (ak) at position 67 the amino acid residue is Z3 or Z4; (al) at position 60 the amino acid residue is Z5; and (am) at position 37 the amino acid residue is Z4 or Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred GAT polypeptides of the invention further comprise amino acid residues in the amino acid sequence that correspond to the positions specified in (a)-(am), wherein at least 90% conform to the amino acid residue restrictions specified in (a)-(am).

Some preferred GAT polypeptides of the invention comprise amino acid residues in the amino acid sequence that correspond to the following positions wherein at least 90% conform to the following additional restrictions: (a) at positions 1, 7, 9, 13, 20, 36, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred GAT polypeptides of the invention comprise amino acid residues in the amino acid sequence that correspond to the following positions wherein at least 90% conform to the following additional restrictions: (a) at positions 1, 7, 9, 13, 20, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 36, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred GAT polypeptides of the invention comprise amino acid residues in the amino acid sequence that correspond to the following positions wherein at least 90% conform to the following additional restrictions: (a) at positions 1, 7, 9, 20, 42, 50, 72, 75, 76, 78, 94, 98, 110, 121, and/or 141 the amino acid residue is Z1; (b) at positions 13, 46, 56, 70, 107, 117, and/or 118 the amino acid residue is Z2; (c) at positions 23, 55, 71, 77, 88, and/or 109 the amino acid residue is Z3; (d) at positions 16, 21, 41, 73, 85, 99, and/or 111 the amino acid residue is Z4; (e) at positions 34 and/or 95 the amino acid residue is Z5; (f) at position 22, 25, 29, 43, 44, 66, 74, 87, 102, 108, 116, 122, 127, 133, 134, 136, and/or 137 the amino acid residue is Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred GAT polypeptides of the invention further comprise an amino acid sequence wherein the amino acid residue at position 36 is selected from the group consisting of Z1 and Z3. Some preferred GAT polypeptides of the invention further comprise an amino acid sequence wherein the amino acid residue at position 64 is selected from the group consisting of Z1 and Z2.

Some preferred GAT polypeptides of the invention comprise an amino acid sequence wherein of the amino acid residues that correspond to the following positions, at least 80% conform to the following additional restrictions: (a) at position 2 the amino acid residue is I or L; (b) at position 3 the amino acid residue is E; (c) at position 4 the amino acid residue is V or I; (d) at position 5 the amino acid residue is K; (e) at position 6 the amino acid residue is P; (f) at position 8 the amino acid residue is N; (g) at position 10 the amino acid residue is E; (h) at position 11 the amino acid residue is D or E; (i) at position 12 the amino acid residue is T; (j) at position 14 the amino acid residue is E or D; (k) at position 15 the amino acid residue is L; (l) at position 17 the amino acid residue is H; (m) at position 18 the amino acid residue is R, E or K; (n) at position 19 the amino acid residue is I or V; (o) at position 24 the amino acid residue is Q; (p) at position 26 the amino acid residue is M, L, V or I; (q) at position 27 the amino acid residue is E; (r) at position 28 the amino acid residue is A or V; (s) at position 30 the amino acid residue is M; (t) at position 31 the amino acid residue is Y or F; (u) at position 32 the amino acid residue is E or D; (v) at position 33 the amino acid residue is T or S; (w) at position 35 the amino acid residue is L; (x) at position 37 the amino acid residue is R, G, E or Q; (y) at position 39 the amino acid residue is A or S; (z) at position 40 the amino acid residue is F or L; (aa) at position 45 the amino acid residue is Y or F; (ab) at position 47 the amino acid residue is R or G; (ac) at position 48 the amino acid residue is G; (ad) at position 49 the amino acid residue is K, R, or Q; (ae) at position 51 the amino acid residue is I or V; (af) at position 52 the amino acid residue is S; (ag) at position 53 the amino acid residue is I or V; (ah) at position 54 the amino acid residue is A; (ai) at position 57 the amino acid residue is H or N; (aj) at position 58 the amino acid residue is Q, K, R or P; (ak) at position 59 the amino acid residue is A; (al) at position 60 the amino acid residue is E; (am) at position 61 the amino acid residue is H or R; (an) at position 63 the amino acid residue is E or D; (ao) at position 65 the amino acid residue is E, P or Q; (ap) at position 67 the amino acid residue is Q or R; (aq) at position 68 the amino acid residue is K or E; (ar) at position 69 the amino acid residue is Q; (as) at position 79 the amino acid residue is E; (at) at position 80 the amino acid residue is G; (au) at position 81 the amino acid residue is Y, H or F; (av) at position 82 the amino acid residue is R; (aw) at position 83 the amino acid residue is E or D; (ax) at position 84 the amino acid residue is Q; (ay) at position 86 the amino acid residue is A; (az) at position 89 the amino acid residue is G, T or S; (ba) at position 90 the amino acid residue is L; (bb) at position 91 the amino acid residue is L, I or V; (bc) at position 92 the amino acid residue is R or K; (bd) at position 93 the amino acid residue is H; (be) at position 96 the amino acid residue is E or Q; (bf) at position 97 the amino acid residue is I; (bg) at position 100 the amino acid residue is K or N; (bh) at position 101 the amino acid residue is K or R; (bi) at position 103 the amino acid residue is A or V; (bj) at position 104 the amino acid residue is D; (bk) at position 105 the amino acid residue is M, L or I; (bl) at position 106 the amino acid residue is L; (bm) at position 112 the amino acid residue is T or A; (bn) at position 113 the amino acid residue is S or T; (bo) at position 114 the amino acid residue is A; (bp) at position 115 the amino acid residue is S; (bq) at position 119 the amino acid residue is K or R; (br) at position 120 the amino acid residue is K or R; (bs) at position 123 the amino acid residue is F or L; (bt) at position 125 the amino acid residue is E; (bu) at position 126 the amino acid residue is Q or H; (by) at position 128 the amino acid residue is E or D; (bw) at position 129 the amino acid residue is V or I; (bx) at position 130 the amino acid residue is F; (by) at position 131 the amino acid residue is D or E; (bx) at position 132 the amino acid residue is T; (ca) at position 135 the amino acid residue is V; (cb) at position 138 the amino acid residue is H; (cc) at position 139 the amino acid residue is I; (cd) at position 140 the amino acid residue is L or M; (ce) at position 142 the amino acid residue is Y; (cf) at position 143 the amino acid residue is K or R; (cg) at position 145 the amino acid residue is L or I; and (ch) at position 146 the amino acid residue is T.

Some preferred GAT polypeptides of the invention comprise an amino acid sequence in which of the residues that correspond to the positions specified in (a)-(ch) above, at least 90% conform to the amino acid residue restrictions specified in (a)-(ch).

Some preferred GAT polypeptides of the invention comprise an amino acid sequence selected from the group consisting of: (a) an amino acid sequence that is at least 98% identical to SEQ ID NO:577; (b) an amino acid sequence that is at least 97% identical to SEQ ID NO:578; (c) an amino acid sequence that is at least 97% identical to SEQ ID NO:621; (d) an amino acid sequence that is at least 98% identical to SEQ ID NO:579; (e) an amino acid sequence that is at least 98% identical to SEQ ID NO:602; (f) an amino acid sequence that is at least 95% identical to SEQ ID NO:697; (g) an amino acid sequence that is at least 96% identical to SEQ ID NO:721; (h) an amino acid sequence that is at least 97% identical to SEQ ID NO:613; (i) an amino acid sequence that is at least 89% identical to SEQ ID NO:677; (j) an amino acid sequence that is at least 96% identical to SEQ ID NO:584; (k) an amino acid sequence that is at least 98% identical to SEQ ID NO:707; (l) an amino acid sequence that is at least 98% identical to SEQ ID NO:616; (m) an amino acid sequence that is at least 96% identical to SEQ ID NO:612; and (n) an amino acid sequence that is at least 98% identical to SEQ ID NO:590, further wherein of the amino acid residues in the amino acid sequence that correspond to the following positions, at least 80% conform to the following restrictions: (a) at positions 9, 76, 94 and 110 the amino acid residue is A; (b) at positions 29 and 108 the amino acid residue is C; (c) at position 34 the amino acid residue is D; (d) at position 95 the amino acid residue is E; (e) at position 56 the amino acid residue is F; (f) at positions 43, 44, 66, 74, 87, 102, 116, 122, 127 and 136 the amino acid residue is G; (g) at position 41 the amino acid residue is H; (h) at position 7 the amino acid residue is I; (i) at position 85 the amino acid residue is K; (j) at positions 20, 42, 50, 78 and 121 the amino acid residue is L; (k) at positions 1 and 141 the amino acid residue is M; (l) at positions 23 and 109 the amino acid residue is N; (m) at positions 22, 25, 133, 134 and 137 the amino acid residue is P; (n) at position 71 the amino acid residue is Q; (o) at positions 16, 21, 73, 99 and 111 the amino acid residue is R; (p) at position 55 the amino acid residue is S; (q) at position 77 the amino acid residue is T; (r) at position 107 the amino acid residue is W; and (s) at position 13, 46, 70 and 118 the amino acid residue is Y.

Some preferred GAT polypeptides of the invention further comprise an amino acid sequence in which at least one of the following criteria is met: (a) at position 14 the amino acid residue is D; (b) at position 18 the amino acid residue is E; (c) at position 26 the amino acid residue is M or V; (e) at position 30 the amino acid residue is I; (f) at position 32 the amino acid residue is D; (g) at position 36 the amino acid residue is M or T; (i) at position 37 the amino acid residue is C; (j) at position 38 the amino acid residue is D; (j) at position 53 the amino acid residue is V; (k) at position 58 the amino acid residue is R; (l) at position 61 the amino acid residue is R; (m) at position 62 the amino acid residue is L; (n) at position 64 the amino acid residue is I or F; (o) at position 65 the amino acid residue is P; (p) at position 72 the amino acid residue is I; (q)

at position 75 the amino acid residue is V; (r) at position 88 the amino acid residue is T; (s) at position 89 the amino acid residue is G; (t) at position 91 the amino acid residue is L; (u) at position 98 the amino acid residue is I; (v) at position 105 the amino acid residue I; (w) at position 112 the amino acid residue is A; (x) at position 124 the amino acid residue is G or C; (y) at position 128 the amino acid residue is D; (z) at position 140 the amino acid residue is M; (aa) at position 143 the amino acid residue is R; and (ab) at position 144 the amino acid residue is W.

Some preferred GAT polypeptides of the invention further comprise an amino acid sequence wherein of the amino acid residues that correspond to the positions specified in (a) through (ab) as described above, at least 80% conform to the amino acid residue restrictions specified in (a) through (ab).

Some preferred GAT polypeptides of the invention further comprise an amino acid sequence wherein the following conditions are also met: (a) at position 41 the amino acid residue is H; (b) at position 138 the amino acid residue is H; (c) at position 34 the amino acid residue is N; and (d) at position 55 the amino acid residue is S.

Some preferred GAT polypeptides of the invention when optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, have amino acid sequences such that one or more of the following positions conform to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P. In certain of the aforementioned GAT polypeptides, the amino acid residue in the polypeptide corresponding to position 28 is V, I or A. Valine or isoleucine at position 28 generally correlates with reduced $K_M$, while alanine at that position generally correlates with increased $k_{cat}$. Threonine at position 89 and arginine at position 58 generally correlates with reduced $K_M$. Other preferred GAT polypeptides are characterized by having 127 (i.e., an I at position 27), M30, D34, S35, R37, S39, H41, G48, K49, N57, Q58, P62, T62, Q65, Q67, K68, V75, E83, S89, A96, E96, R101, T112, A114, K119, K120, E128, V129, D131, T131, V132, V134, V135, H138, R144, I145, or T146, or any combination thereof.

Some preferred GAT polypeptides of the invention comprise an amino acid sequence selected from the group consisting of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819 ,821, 823 and 825.

In another aspect, the invention provides an isolated or recombinant polypeptide that comprises at least 20, or alternatively, at least 50, at least 75, at least 100, at least 125, at least 130, at least 135, at least 140, at least 141, at least 142, at least 143, at least 144 or at least 145 contiguous amino acids of an amino acid sequence selected from the groups consisting of: (a) an amino acid sequence that is at least 96% identical to SEQ ID NO:919 (such as, for example, SEQ ID NO:917, 919, 921, 923, 925, 927, 833, 835, 839, 843, 845, 859, 863, 873, 877, 891, 895, 901, 905, 907, 913, 915, or 950); (b) an amino acid sequence that is at least 97% identical to SEQ ID NO:929 (such as, for example, SEQ ID NO:929, 931, 835, 843, 849, or 867); (c) an amino acid sequence that is at least 98% identical to SEQ ID NO:847 (such as, for example, SEQ ID NO:845 or 847); (d) an amino acid sequence that is at least 98% identical to SEQ ID NO:851; (e) an amino acid sequence that is at least 98% identical to SEQ ID NO:853; (f) an amino acid sequence that is at least 98% identical to SEQ ID NO:855 (such as, for example, SEQ ID NO:835 or 855); (g) an amino acid sequence that is at least 98% identical to SEQ ID NO:857; (h) an amino acid sequence that is at least 98% identical to SEQ ID NO:861 (such as, for example, SEQ ID NO:839, 861, or 883); (i) an amino acid sequence that is at least 98% identical to SEQ ID NO:871; (j) an amino acid sequence that is at least 98% identical to SEQ ID NO:875; (k) an amino acid sequence that is at least 98% identical to SEQ ID NO:881; (l) an amino acid sequence that is at least 98% identical to SEQ ID NO:885 (such as, for example, SEQ ID NO:845 or 885); (m) an amino acid sequence that is at least 98% identical to SEQ ID NO:887; (n) an amino acid sequence that is at least 98% identical to SEQ ID NO:889 (such as, for example, SEQ ID NO: 863, 889, 891, or 903); (o) an amino acid sequence that is at least 98% identical to SEQ ID NO:893; (p) an amino acid sequence that is at least 98% identical to SEQ ID NO:897; (q) an amino acid sequence that is at least 98% identical to SEQ ID NO:899; (r) an amino acid sequence that is at least 98% identical to SEQ ID NO:909 (such as, for example, SEQ ID NO:883 or 909); (s) an amino acid sequence that is at least 98% identical to SEQ ID NO:911; (t) an amino acid sequence that is at least 99% identical to SEQ ID NO:837; (u) an amino acid sequence that is at least 99% identical to SEQ ID NO:841; (v) an amino acid sequence that is at least 99% identical to SEQ ID NO:865; (w) an amino acid sequence that is at least 99% identical to SEQ ID NO:869; and (x) an amino acid sequence that is at least 99% identical to SEQ ID NO:879.

In another aspect, the invention provides an isolated or recombinant polypeptide that comprises at least 20, or alternatively, at least 50, at least 75, at least 100, at least 125, at least 130, at least 135, at least 140, at least 141, at least 142, at least 143, at least 144 or at least 145 contiguous amino acids of an amino acid sequence that is at least 95% identical to SEQ ID NO:929 and which comprises a Gly or an Asn residue at the amino acid position corresponding to position 33 of SEQ ID NO:929 (such as, for example, SEQ ID NO:837, 849, 893, 897, 905, 921, 927, 929 or 931).

In another aspect, the invention provides a polypeptide comprising residues 2-146 of an amino acid sequence selected from the group consisting of SEQ ID NO: 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972. In some embodiments of the invention, the amino acid sequence of the polypeptide comprises Met, Met-Ala, or Met-Ala-Ala on the N-terminal side of the amino acid corresponding to position 2 of the reference amino acid sequence.

Some preferred GAT polypeptides of the invention comprise an amino acid sequence selected from the group consisting of SEQ ID NO: 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 946, 948, and 950.

The invention further provides preferred GAT polypeptides that are characterized by a combination of the foregoing amino acid residue position restrictions.

In addition, the invention provides GAT polynucleotides encoding the preferred GAT polypeptides described above, and complementary nucleotide sequences thereof.

Some aspects of the invention pertain particularly to the subset of any of the above-described categories of GAT polypeptides having GAT activity, as described herein. These GAT polypeptides are preferred, for example, for use as agents for conferring glyphosate resistance upon a plant. Examples of desired levels of GAT activity are described herein.

In one aspect, the GAT polypeptides comprise an amino acid sequence encoded by a recombinant or isolated form of naturally occurring nucleic acids isolated from a natural source, e.g., a bacterial strain. Wild-type polynucleotides encoding such GAT polypeptides may be specifically screened for by standard techniques known in the art. The polypeptides defined by SEQ ID NO:6-10, for example, were discovered by expression cloning of sequences from *Bacillus* strains exhibiting GAT activity, as described in more detail below.

The invention also includes isolated or recombinant polypeptides which are encoded by an isolated or recombinant polynucleotide comprising a nucleotide sequence which hybridizes under stringent conditions over substantially the entire length of a nucleotide sequence selected from the group consisting of SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, and 824, their complements, and nucleotide sequences encoding an amino acid sequence selected from the group consisting of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, and 825, including their complements.

The invention also includes isolated or recombinant polypeptides which are encoded by an isolated or recombinant polynucleotide comprising a nucleotide sequence which hybridizes under stringent conditions over substantially the entire length of a nucleotide sequence selected from the group consisting of SEQ ID NO: 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, and 930, their complements, and nucleotide sequences encoding an amino acid sequence selected from the group consisting of SEQ ID NO: 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972.

The invention further includes any polypeptide having GAT activity that is encoded by a fragment of any of the GAT-encoding polynucleotides described herein.

The invention also provides fragments of GAT polypeptides that can be spliced together to form a functional GAT polypeptide. Splicing can be accomplished in vitro or in vivo, and can involve cis- or trans-splicing (i.e., intramolecular or intermolecular splicing). The fragments themselves can, but need not, have GAT activity. For example, two or more segments of a GAT polypeptide can be separated by inteins; removal of the intein sequence by cis-splicing results in a functional GAT polypeptide. In another example, an encrypted GAT polypeptide can be expressed as two or more separate fragments; trans-splicing of these segments results in recovery of a functional GAT polypeptide. Various aspects of cis- and trans-splicing, gene encryption, and introduction of intervening sequences are described in more detail in U.S. patent application Ser. Nos. 09/517,933 and 09/710,686, both of which are incorporated by reference herein in their entirety.

In general, the invention includes any polypeptide encoded by a modified GAT polynucleotide derived by mutation, recursive sequence recombination, and/or diversification of the polynucleotide sequences described herein. In some aspects of the invention, a GAT polypeptide is modified by single or multiple amino acid substitutions, a deletion, an insertion, or a combination of one or more of these types of modifications. Substitutions can be conservative or non-conservative, can alter function or not, and can add new function. Insertions and deletions can be substantial, such as the case of a truncation of a substantial fragment of the sequence, or in the fusion of additional sequence, either internally or at N or C terminal. In some embodiments of the invention, a GAT polypeptide is part of a fusion protein comprising a functional addition such as, for example, a secretion signal, a chloroplast transit peptide, a purification tag, or any of the numerous other functional groups that will be apparent to the skilled artisan and which are described in more detail elsewhere in this specification.

Polypeptides of the invention may contain one or more modified amino acid. The presence of modified amino acids may be advantageous in, for example, (a) increasing polypeptide in vivo half-life, (b) reducing or increasing polypeptide antigenicity, and (c) increasing polypeptide storage stability. Amino acid(s) are modified, for example, co-translationally or post-translationally during recombinant production (e.g., N-linked glycosylation at N—X—S/T motifs during expression in mammalian cells) or modified by synthetic means.

Non-limiting examples of a modified amino acid include a glycosylated amino acid, a sulfated amino acid, a prenlyated (e.g., farnesylated, geranylgeranylated) amino acid, an acetylated amino acid, an acylated amino acid, a PEG-ylated amino acid, a biotinylated amino acid, a carboxylated amino acid, a phosphorylated amino acid, and the like. References adequate to guide one of skill in the modification of amino acids are replete throughout the literature. Example protocols are found in Walker (1998) *Protein Protocols on CD-ROM* (Humana Press, Towata, N.J.).

Recombinant methods for producing and isolating GAT polypeptides of the invention are described herein. In addition to recombinant production, the polypeptides may be produced by direct peptide synthesis using solid-phase techniques (e.g., Stewart et al. (1969) *Solid-Phase Peptide Synthesis* (WH Freeman Co, San Francisco); and Merrifield (1963) *J. Am. Chem. Soc.* 85: 2149-2154). Peptide synthesis may be performed using manual techniques or by automation. Automated synthesis may be achieved, for example, using Applied Biosystems 431A Peptide Synthesizer (Perkin Elmer, Foster City, Calif.) in accordance with the instructions provided by the manufacturer. For example, subsequences may be chemically synthesized separately and combined using chemical methods to provide full-length GAT polypeptides. Peptides can also be ordered from a variety of sources.

In another aspect of the invention, a GAT polypeptide of the invention is used to produce antibodies which have, e.g., diagnostic uses, for example, related to the activity, distribution, and expression of GAT polypeptides, for example, in various tissues of a transgenic plant.

GAT homologue polypeptides for antibody induction do not require biological activity; however, the polypeptide or oligopeptide must be antigenic. Peptides used to induce specific antibodies may have an amino acid sequence consisting of at least 10 amino acids, preferably at least 15 or 20 amino acids. Short stretches of a GAT polypeptide may be fused with another protein, such as keyhole limpet hemocyanin, and an antibody produced against the chimeric molecule.

Methods of producing polyclonal and monoclonal antibodies are known to those of skill in the art, and many antibodies are available. See, e.g., Coligan (1991) *Current Protocols in Immunology* (Wiley/Greene, NY); Harlow and Lane (1989) *Antibodies: A Laboratory Manual* (Cold Spring Harbor Press, NY); Stites et al. (eds.) *Basic and Clinical Immunology,* 4th ed. (Lange Medical Publications, Los Altos, Calif.), and references cited therein; Goding (1986) *Monoclonal Antibodies: Principles and Practice,* 2d ed. (Academic Press, New York, N.Y.); and Kohler and Milstein (1975) *Nature* 256: 495-497. Other suitable techniques for antibody preparation include selection of libraries of recombinant antibodies in phage or similar vectors. See, Huse et al. (1989) *Science* 246: 1275-1281; and Ward et al. (1989) *Nature* 341: 544-546. Specific monoclonal and polyclonal antibodies and antisera will usually bind with a $K_D$ of at least about 0.1 µM, preferably at least about 0.01 µM or better, and most typically and preferably, 0.001 µM or better.

Additional details antibody of production and engineering techniques can be found in Borrebaeck, ed. (1995) *Antibody Engineering,* $2^{nd}$ ed. (Freeman and Company, NY); McCafferty et al. (1996) *Antibody Engineering, A Practical Approach* (IRL at Oxford Press, Oxford, England); and Paul (1995) *Antibody Engineering Protocols* (Humana Press, Towata, N.J.).

Sequence Variations

GAT polypeptides of the present invention include conservatively modified variations of the sequences disclosed herein as SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972. Such conservatively modified variations comprise substitutions, additions or deletions which alter, add or delete a single amino acid or a small percentage of amino acids (typically less than about 5%, more typically less than about 4%, 2%, or 1%) in any of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972.

For example, a conservatively modified variation (e.g., deletion) of the 146 amino acid polypeptide identified herein as SEQ ID NO:6 will have a length of at least 140 amino acids, preferably at least 141 amino acids, more preferably at least 144 amino acids, and still more preferably at least 145 amino acids, corresponding to a deletion of less than about 5%, 4%, 2% or about 1%, or less of the polypeptide sequence.

Another example of a conservatively modified variation (e.g., a "conservatively substituted variation") of the polypeptide identified herein as SEQ ID NO:6 will contain "conservative substitutions," according to the six substitution groups set forth in Table 2, in up to about 7 residues (i.e., less than about 5%) of the 146 amino acid polypeptide.

The GAT polypeptide sequence homologues of the invention, including conservatively substituted sequences, can be present as part of larger polypeptide sequences such as occur in a GAT polypeptide, in a GAT fusion with a signal sequence, e.g., a chloroplast targeting sequence, or upon the addition of one or more domains for purification of the protein (e.g., poly his segments, FLAG tag segments, etc.). In the latter case, the additional functional domains have little or no effect on the activity of the GAT portion of the protein, or where the additional domains can be removed by post synthesis processing steps such as by treatment with a protease.

Defining Polypeptides by Immunoreactivity

Because the polypeptides of the invention provide a new class of enzymes with a defined activity, i.e., the acetylation and acylation of glyphosate, the polypeptides also provide new structural features which can be recognized, e.g., in immunological assays. The generation of antisera which specifically binds the polypeptides of the invention, as well as the polypeptides which are bound by such antisera, are a feature of the invention.

The invention includes GAT polypeptides that specifically bind to or that are specifically immunoreactive with an antibody or antisera generated against an immunogen comprising an amino acid sequence selected from one or more of SEQ ID NO: 568, 569, 570, 571, 572, 573, 574, 575, 576; 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972. To eliminate cross-reactivity with other GAT homologues, the antibody or antisera is subtracted with available related proteins, such as those represented by the proteins or peptides corresponding to GenBank accession numbers available as of the filing date of this application, and exemplified by CAA70664, Z99109 and Y09476. Where the accession number corresponds to a nucleic acid, a polypeptide encoded by the nucleic acid is generated and used for antibody/antisera subtraction purposes. FIG. 3 tabulates the relative identity between exemplary GAT sequences and the most closely related sequence available in Genbank, YitI. The function of native YitI has yet to be elucidated, but the enzyme has been shown to possess detectable GAT activity.

In one typical format, the immunoassay uses a polyclonal antiserum which was raised against one or more polypeptides comprising one or more of the sequences corresponding to one or more of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972, or a substantial subsequence thereof (i.e., at least about 30% of the full length sequence provided). The full set of potential polypeptide immunogens derived from SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 953, 954, 955, 956, 957, 958, 959, 960, 961, 962, 963, 964, 965, 966, 967, 968, 969, 970, 971, and 972 are collectively referred to below as "the immunogenic polypeptide(s)." The resulting antisera is optionally selected to have low cross-reactivity against other related sequences and any such cross-reactivity is removed by immunoabsorbtion with one or more of the related sequences, prior to use of the polyclonal antiserum in the immunoassay.

In order to produce antisera for use in an immunoassay, one or more of the immunogenic polypeptide(s) is produced and purified as described herein. For example, recombinant protein may be produced in a bacterial cell line. An inbred strain of mice (used in this assay because results are more reproducible due to the virtual genetic identity of the mice) is immunized with the immunogenic polypeptide(s) in combination with a standard adjuvant, such as Freund's adjuvant, using a standard mouse immunization protocol (see, Harlow and Lane (1988) *Antibodies, A Laboratory Manual* (Cold Spring Harbor Publications, New York), for a standard description of antibody generation, immunoassay formats and conditions that can be used to determine specific immunoreactivity). Alternatively, one or more synthetic or recombinant polypeptides derived from the sequences disclosed herein is conjugated to a carrier protein and used as an immunogen.

Polyclonal sera are collected and titered against the immunogenic polypeptide(s) in an immunoassay, for example, a solid phase immunoassay with one or more of the immunogenic proteins immobilized on a solid support. Polyclonal antisera with a titer of $10^6$ or greater are selected, pooled and subtracted with related polypeptides, e.g., those identified from GENBANK as noted, to produce subtracted, pooled, titered polyclonal antisera.

The subtracted, pooled, titered polyclonal antisera are tested for cross reactivity against the related polypeptides. Preferably at least two of the immunogenic GATs are used in this determination, preferably in conjunction with at least two related polypeptides, to identify antibodies which are specifically bound by the immunogenic polypeptide(s).

In this comparative assay, discriminatory binding conditions are determined for the subtracted, titered polyclonal antisera which result in at least about a 5-10 fold higher signal to noise ratio for binding of the titered polyclonal antisera to the immunogenic GAT polypeptides as compared to binding to the related polypeptides. That is, the stringency of the binding reaction is adjusted by the addition of non-specific competitors such as albumin or non-fat dry milk, or by adjusting salt conditions, temperature, or the like. These binding conditions are used in subsequent assays for determining whether a test polypeptide is specifically bound by the pooled, subtracted polyclonal antisera. In particular, a test polypeptide which shows at least a 2-5 fold higher signal to noise ratio than the control polypeptide under discriminatory binding conditions, and at least about a ½ signal to noise ratio as compared to the immunogenic polypeptide(s), shares substantial structural similarity with the immunogenic polypeptide(s) as compared to known GAT, and is, therefore a polypeptide of the invention.

In another example, immunoassays in the competitive binding format are used for the detection of a test polypeptide. For example, as noted, cross-reacting antibodies are removed from the pooled antisera mixture by immunoabsorption with the control GAT polypeptides. The immunogenic polypeptide(s) are then immobilized to a solid support which is exposed to the subtracted pooled antisera. Test proteins are added to the assay to compete for binding to the pooled, subtracted antisera. The ability of the test protein(s) to compete for binding to the pooled, subtracted antisera as compared to the immobilized protein(s) is compared to the ability of the immunogenic polypeptide(s) added to the assay to compete for binding (the immunogenic polypeptide(s) compete effectively with the immobilized immunogenic polypeptide(s) for binding to the pooled antisera). The percent cross-reactivity for the test proteins is calculated, using standard calculations.

In a parallel assay, the ability of the control proteins to compete for binding to the pooled, subtracted antisera is optionally determined as compared to the ability of the immunogenic polypeptide(s) to compete for binding to the antisera. Again, the percent cross-reactivity for the control polypeptides is calculated, using standard calculations. Where the percent cross-reactivity is at least 5-10× higher for the test polypeptides, the test polypeptides are said to specifically bind the pooled, subtracted antisera.

In general, the immunoabsorbed and pooled antisera can be used in a competitive binding immunoassay as described herein to compare any test polypeptide to the immunogenic polypeptide(s). In order to make this comparison, the two polypeptides are each assayed at a wide range of concentrations and the amount of each polypeptide required to inhibit 50% of the binding of the subtracted antisera to the immobilized protein is determined using standard techniques. If the amount of the test polypeptide required is less than twice the amount of the immunogenic polypeptide(s) that is required, then the test polypeptide is said to specifically bind to an antibody generated to the immunogenic polypeptide(s), provided the amount is at least about 5-10× higher for a control polypeptide.

As a final determination of specificity, the pooled antisera is optionally filly immunosorbed with the immunogenic polypeptide(s) (rather than the control polypeptides) until little or no binding of the subtracted, pooled antisera to the immunogenic polypeptide(s) is detectable. This fully immunosorbed antisera is then tested for reactivity with the test polypeptide. If little or no reactivity is observed (i.e., no more than 2× the signal to noise ratio observed for binding of the fully immunosorbed antisera to the immunogenic polypeptide(s)), then the test polypeptide is specifically bound by the antisera elicited by the immunogenic polypeptide(s).

Glyphosate-N-Acetyltransferase Polynucleotides

In one aspect, the invention provides a novel family of isolated or recombinant polynucleotides referred to herein as "glyphosate-N-acetyltransferase polynucleotides" or "GAT polynucleotides." GAT polynucleotide sequences are characterized by the ability to encode a GAT polypeptide. In general, the invention includes any nucleotide sequence that encodes any of the novel GAT polypeptides described herein. In some aspects of the invention, a GAT polynucleotide that encodes a GAT polypeptide with GAT activity is preferred.

Figure 2:
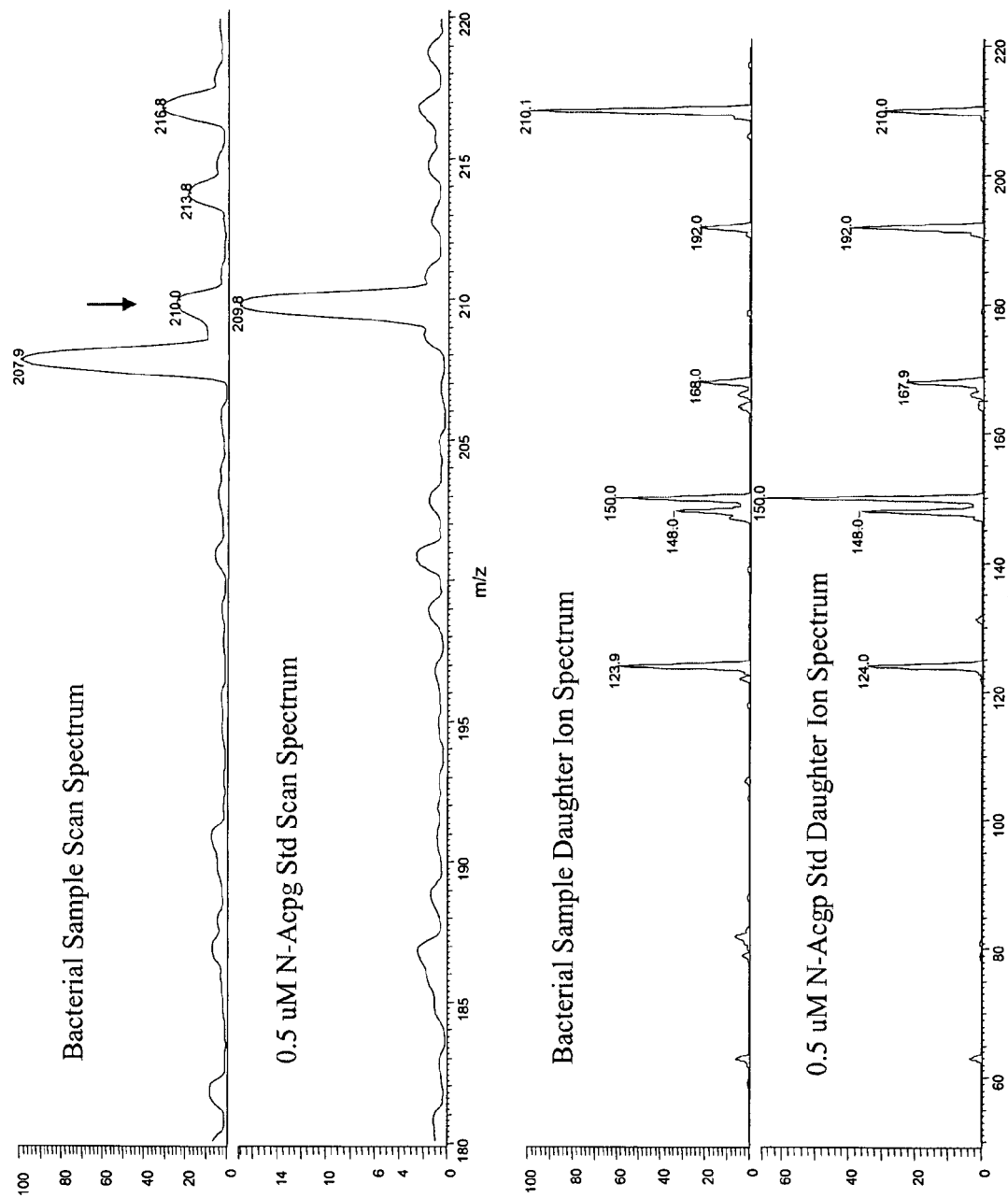
FIG. 2 illustrates mass spectroscopic detection of N-acetylglyphosate produced by an exemplary *Bacillus* culture expressing a native GAT activity. Relative abundance is shown on the vertical axis.

In one aspect, the GAT polynucleotides comprise recombinant or isolated forms of naturally occurring nucleic acids isolated from an organism, e.g., a bacterial strain. Exemplary GAT polynucleotides, e.g., SEQ ID NO:1-5, were discovered by expression cloning of sequences from Bacillus strains exhibiting GAT activity. Briefly, a collection of approximately 500 Bacillus and Pseudomonas strains were screened for native ability to N-acetylate glyphosate. Strains were grown in LB overnight, harvested by centrifugation, permeabilized in dilute toluene, and then washed and resuspended in a reaction mix containing buffer, 5 mM glyphosate, and 200 µM acetyl-CoA. The cells were incubated in the reaction mix for between 1 and 48 hours, at which time an equal volume of methanol was added to the reaction. The cells were then pelleted by centrifugation and the supernatant was filtered before analysis by parent ion mode mass spectrometry. The product of the reaction was positively identified as N-acetylglyphosate by comparing the mass spectrometry profile of the reaction mix to an N-acetylglyphosate standard as shown in FIG. 2. Product detection was dependent on inclusion of both substrates (acetyl CoA and glyphosate) and was abolished by heat denaturing the bacterial cells.

Individual GAT polynucleotides were then cloned from the identified strains by functional screening. Genomic DNA was prepared and partially digested with Sau3A1 enzyme. Fragments of approximately 4 kb were cloned into an E. coli expression vector and transformed into electrocompetent E. coli. Individual clones exhibiting GAT activity were identified by mass spectrometry following a reaction as described previously except that the toluene wash was replaced by permeabilization with PMBS. Genomic fragments were sequenced and the putative GAT polypeptide-encoding open reading frame was identified. Identity of the GAT gene was confirmed by expression of the open reading frame in E. coli and detection of high levels of N-acetylglyphosate produced from reaction mixtures.

In another aspect of the invention, GAT polynucleotides are produced by diversifying, e.g., recombining and/or mutating one or more naturally occurring, isolated, or recombinant GAT polynucleotides. As described in more detail elsewhere herein, it is often possible to generate diversified GAT polynucleotides encoding GAT polypeptides with superior functional attributes, e.g., increased catalytic function, increased stability, or higher expression level, than a GAT polynucleotide used as a substrate or parent in the diversification process.

The polynucleotides of the invention have a variety of uses in, for example: recombinant production (i.e., expression) of the GAT polypeptides of the invention; as transgenes (e.g., to confer herbicide resistance in transgenic plants); as selectable markers for transformation and plasmid maintenance; as immunogens; as diagnostic probes for the presence of complementary or partially complementary nucleic acids (including for detection of natural GAT coding nucleic acids); as substrates for further diversity generation, e.g., recombination reactions or mutation reactions to produce new and/or improved GAT homologues, and the like.

It is important to note that certain specific, substantial and credible utilities of GAT polynucleotides do not require that the polynucleotide encode a polypeptide with substantial GAT activity. For example, GAT polynucleotides that do not encode active enzymes can be valuable sources of parental polynucleotides for use in diversification procedures to arrive at GAT polynucleotide variants, or non-GAT polynucleotides, with desirable functional properties (e.g., high $k_{cat}$ or $k_{cat}/K_m$, low $K_m$, high stability towards heat or other environmental factors, high transcription or translation rates, resistance to proteolytic cleavage, reducing antigenicity, etc.). For example, nucleotide sequences encoding protease variants with little or no detectable activity have been used as parent polynucleotides in DNA shuffling experiments to produce progeny encoding highly active proteases (Ness et al. (1999) *Nature Biotech.* 17:893-96).

Polynucleotide sequences produced by diversity generation methods or recursive sequence recombination ("RSR") methods (e.g., DNA shuffling) are a feature of the invention. Mutation and recombination methods using the nucleic acids described herein are a feature of the invention. For example, one method of the invention includes recursively recombining one or more nucleotide sequences of the invention as described above and below with one or more additional nucleotides. The recombining steps are optionally performed in vivo, ex vivo, in silico or in vitro. This diversity generation or recursive sequence recombination produces at least one library of recombinant modified GAT polynucleotides. Polypeptides encoded by members of this library are included in the invention.

Also contemplated are uses of polynucleotides, also referred to herein as oligonucleotides, typically having at least 12 bases, preferably at least 15, more preferably at least 20, 30, or 50 or more bases, which hybridize under stringent or highly stringent conditions to a GAT polynucleotide sequence. The polynucleotides may be used as probes, primers, sense and antisense agents, and the like, according to methods as noted herein.

In accordance with the present invention, GAT polynucleotides, including nucleotide sequences that encode GAT polypeptides, fragments of GAT polypeptides, related fusion proteins, or functional equivalents thereof, are used in recombinant DNA molecules that direct the expression of the GAT polypeptides in appropriate host cells, such as bacterial or plant cells. Due to the inherent degeneracy of the genetic code, other nucleic acid sequences which encode substantially the same or a functionally equivalent amino acid sequence can also be used to clone and express the GAT polynucleotides.

The invention provides GAT polynucleotides that encode transcription and/or translation products that are subsequently spliced to ultimately produce functional GAT polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate a GAT polypeptide encoding sequence. An example of trans-splicing would be where a GAT polynucleotide is encrypted by separating the coding sequence into two or more fragments that can be separately transcribed and then spliced to form the full-length GAT encoding sequence. The use of a splicing enhancer sequence (which can be introduced into a construct of the invention) can facilitate splicing either in cis or trans. Cis- and trans-splicing of polypeptides are described in more detail elsewhere herein and in U.S. patent application Ser. Nos. 09/517,933 and 09/710,686.

Thus, some GAT polynucleotides do not directly encode a full-length GAT polypeptide, but rather encode a fragment or fragments of a GAT polypeptide. These GAT polynucleotides can be used to express a functional GAT polypeptide through a mechanism involving splicing, where splicing can occur at the level of polynucleotide (e.g., intron/exon) and/or polypeptide (e.g., intein/extein). This can be useful, for example, in controlling expression of GAT activity, since functional GAT polypeptide will only be expressed if all required fragments are expressed in an environment that permits splicing processes to generate functional product. In another example, introduction of one or more insertion sequences into a GAT polynucleotide can facilitate recombination with a low homology polynucleotide; use of an intron or intein for the insertion sequence facilitates the removal of the intervening sequence, thereby restoring function of the encoded variant.

As will be understood by those of skill in the art, it can be advantageous to modify a coding sequence to enhance its expression in a particular host. The genetic code is redundant with 64 possible codons, but most organisms preferentially use a subset of these codons. The codons that are utilized most often in a species are called optimal codons, and those not utilized very often are classified as rare or low-usage codons (see, e.g., Zhang et al. (1991) *Gene* 105:61-72). Codons can be substituted to reflect the preferred codon usage of the host, a process sometimes called "codon optimization" or "controlling for species codon bias."

Optimized coding sequences containing codons preferred by a particular prokaryotic or eukaryotic host (see also, Murray et al. (1989) *Nucl. Acids Res.* 17:477-508) can be prepared, for example, to increase the rate of translation or to produce recombinant RNA transcripts having desirable properties, such as a longer half-life, as compared with transcripts produced from a non-optimized sequence. Translation stop codons can also be modified to reflect host preference. For example, preferred stop codons for *S. cerevisiae* and mammals are UAA and UGA, respectively. The preferred stop codon for monocotyledonous plants is UGA, whereas insects and *E. coli* prefer to use UAA as the stop codon (Dalphin et al. (1996) *Nucl. Acids Res.* 24: 216-218). Methodology for optimizing a nucleotide sequence for expression in a plant is provided, for example, in U.S. Pat. No. 6,015,891, and the references cited therein.

One embodiment of the invention includes a GAT polynucleotide having optimal codons for expression in a relevant host, e.g., a transgenic plant host. This is particularly desirable when a GAT polynucleotide of bacterial origin is introduced into a transgenic plant, e.g., to confer glyphosate resistance to the plant.

The polynucleotide sequences of the present invention can be engineered in order to alter a GAT polynucleotide for a variety of reasons, including but not limited to alterations which modify the cloning, processing and/or expression of the gene product. For example, alterations may be introduced using techniques that are well known in the art, e.g., site-directed mutagenesis, to insert new restriction sites, alter glycosylation patterns, change codon preference, introduce splice sites, etc.

As described in more detail herein, the polynucleotides of the invention include sequences which encode novel GAT polypeptides and sequences complementary to the coding sequences, and novel fragments of coding sequences and complements thereof. The polynucleotides can be in the form of RNA or in the form of DNA, and include mRNA, cRNA, synthetic RNA and DNA, genomic DNA and cDNA. The polynucleotides can be double-stranded or single-stranded, and if single-stranded, can be the coding strand or the non-coding (anti-sense, complementary) strand. The polynucleotides optionally include the coding sequence of a GAT polypeptide (i) in isolation, (ii) in combination with an additional coding sequence, so as to encode, e.g., a fusion protein, a pre-protein, a prepro-protein, or the like, (iii) in combination with non-coding sequences, such as introns or inteins, control elements such as a promoter, an enhancer, a terminator element, or 5' and/or 3' untranslated regions effective for expression of the coding sequence in a suitable host, and/or (iv) in a vector or host environment in which the GAT polynucleotide is a heterologous gene. Sequences can also be found in combination with typical compositional formulations of nucleic acids, including in the presence of carriers, buffers, adjuvants, excipients and the like.

Polynucleotides and oligonucleotides of the invention can be prepared by standard solid-phase methods, according to known synthetic methods. Typically, fragments of up to about 100 bases are individually synthesized, then joined (e.g., by enzymatic or chemical ligation methods, or polymerase mediated methods) to form essentially any desired continuous sequence. For example, polynucleotides and oligonucleotides of the invention can be prepared by chemical synthesis using, e.g., the classical phosphoramidite method described by Beaucage et al. (1981) *Tetrahedron Letters* 22:1859-69, or the method described by Matthes et al. (1984) *EMBO J.* 3: 801-05, e.g., as is typically practiced in automated synthetic methods. According to the phosphoramidite method, oligonucleotides are synthesized, e.g., in an automatic DNA synthesizer, purified, annealed, ligated and cloned in appropriate vectors.

In addition, essentially any nucleic acid can be custom ordered from any of a variety of commercial sources, such as The Midland Certified Reagent Company (mcrc@oligos.com), The Great American Gene Company (www.genco.com), ExpressGen Inc. (www.expressgen-.com), Operon Technologies Inc. (Alameda, Calif.) and many others. Similarly, peptides and antibodies can be custom ordered from any of a variety of sources, such as PeptidoGenic (pkim@ccnet.com), HTI Bio-products, Inc. (www.htibio.com), BMA Biomedicals Ltd (U.K.), Bio.Synthesis, Inc., and many others.

Polynucleotides may also be synthesized by well-known techniques as described in the technical literature. See, e.g., Carruthers et al., *Cold Spring Harbor Symp. Quant. Biol.* 47: 411-418 (1982), and Adams et al. (1983) *J. Am. Chem. Soc.* 105: 661. Double stranded DNA fragments may then be obtained either by synthesizing the complementary strand and annealing the strands together under appropriate conditions, or by adding the complementary strand using DNA polymerase with an appropriate primer sequence.

General texts which describe molecular biological techniques useful herein, including mutagenesis, include Berger and Kimmel, *Guide to Molecular Cloning Techniques, Methods in Enzymology*, Volume 152 (Academic Press, Inc., San Diego, Calif.); Sambrook et al. (1989) *Molecular Cloning-A Laboratory Manual,* 2nd ed., Volumes 1-3 (Cold Spring Harbor Laboratory, Cold Spring Harbor, N.Y.); and Ausubel et al., eds. (2000) *Current Protocols in Molecular Biology* (Greene Publishing Associates, Inc. and John Wiley & Sons, Inc.). Examples of techniques sufficient to direct persons of skill through in vitro amplification methods, including the polymerase chain reaction (PCR), the ligase chain reaction (LCR), Qβ-replicase amplification and other RNA polymerase mediated techniques (e.g., NASBA) are found in Berger, Sambrook, and Ausubel, as well as in Mullis et al. (1987) U.S. Pat. No. 4,683,202; Innis et al., eds. (1990) *PCR Protocols: A Guide to Methods and Applications* (Academic Press Inc. San Diego, Calif.); Arnheim & Levinson (Oct. 1, 1990) *Chemical and Engineering News* 36-47; *The Journal Of NIH Research* (1991) 3: 81-94; Kwoh et al. (1989) *Proc. Nat'l. Acad. Sci. USA* 86: 1173; Guatelli et al. (1990) *Proc. Nat'l. Acad. Sci. USA* 87: 1874; Lomell et al. (1989) *J. Clin. Chem.* 35: 1826; Landegren et al. (1988) *Science* 241: 1077-1080; Van Brunt (1990) *Biotechnology* 8: 291-294; Wu and Wallace (1989) *Gene* 4: 560; Barringer et al. (1990) *Gene* 89: 117, and Sooknanan and Malek (1995) *Biotechnology* 13: 563-564. Improved methods of cloning in vitro amplified nucleic acids are described in Wallace et al. U.S. Pat. No. 5,426,039. Improved methods of amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, Ausbel, Sambrook and Berger, all supra.

One aspect of the invention provides an isolated or recombinant polynucleotide selected from the group consisting of SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952.

Preferred polynucleotides of the present invention include an isolated or recombinant polynucleotide sequence encoding and amino acid sequence that can be optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, wherein one or more of the following positions conform to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P, and further wherein of the amino acid residues in the amino acid sequence that correspond to the following positions, at least 90% conform to the following restrictions: (a) at positions 2, 4, 15, 19, 26, 28, 31, 45, 51, 54, 86, 90, 91, 97, 103, 105, 106, 114, 123, 129, 139, and/or 145 the amino acid residue is B1; and (b) at positions 3,5,8, 10, 11, 14, 17, 24, 27, 32,37,47,48, 49,52,57, 58, 61, 63, 68, 69, 79, 80, 82, 83, 89, 92, 100, 101, 104, 119, 120, 125, 126, 128, 131, and/or 143 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T. When used to specify an amino acid or amino acid residue, the single letter designations A, C, D, E, F, G, H, I, K, L, M, N, P, Q, R, S, T, V, W, and Y have their standard meaning as used in the art and as provided in Table 1 herein.

Some preferred isolated or recombinant polynucleotides of the invention encode an amino acid sequence such that when the sequence is optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, one or more of the following positions conform to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P, and further wherein of the amino acid residues in the amino acid sequence that correspond to the following positions, at least 80% conform to the following restrictions: (a) at positions 2, 4, 15, 19, 26, 28, 51, 54, 86, 90, 91, 97, 103, 105, 106, 114, 129, 139, and/or 145 the amino acid residue is Z1; (b) at positions 31 and/or 45 the amino acid residue is Z2; (c) at position 8 the amino acid residue is Z3; (d) at position 89 the amino acid residue is Z3 or Z6; (e) at positions 82, 92, 101 and/or 120 the amino acid residue is Z4; (f) at positions 3, 11, 27 and/or 79 the amino acid residue is Z5; (g) at position 18 the amino acid residue is Z4 or Z5; (h) at position 123 the amino acid residue is Z1 or Z2; (i) at positions 12, 33, 35, 39, 53, 59, 112, 132, 135, 140, and/or 146 the amino acid residue is Z1 or Z3; (j) at position 30 the amino acid residue is Z1; (k) at position 6 the amino acid residue is Z6; (l) at position 81 the amino acid residue is Z2 or Z4; (m) at position 113 the amino acid residue is Z3; (n) at position 138 the amino acid residue is Z4; (o) at position 142 the amino acid residue is Z2; (p) at positions 57 and/or 126 the amino acid residue is Z3 or Z4; (q) at position 5, 17, and 61 the amino acid residue is Z4; (r) at position 24 the amino acid residue is Z3; (s) at position 104 the amino acid residue is Z5; (t) at positions 52 and/or 69 the amino acid residue is Z3; (u) at positions 14 and/or 119 the amino acid residue is Z5; (v) at positions 10, 32, 63, and/or 83 the amino acid residue is Z5; (w) at positions 48 and/or 80 the amino acid residue is Z6; (x) at position 40 the amino acid residue is Z1 or Z2; (y) at position 96 the amino acid residue is Z3 or Z5; (z) at position 65 the amino acid residue is Z3, Z4, or Z6; (aa) at positions 84 and/or 115 the amino acid residue is Z3; (ab) at position 93 the amino acid residue is Z4; (ac) at position 130 the amino acid residue is Z2; (ad) at position 58 the amino acid residue is Z3, Z4, or Z6; (ae) at position 47 the amino acid residue is Z4 or Z6; (af) at positions 49 and/or 100 the amino acid residue is Z3 or Z4; (ag) at position 68 the amino acid residue is Z4 or Z5; (ah) at position 143 the amino acid residue is Z4; (ai) at position 131 the amino acid residue is Z5; (aj) at positions 125 and/or 128 the amino acid residue is Z5; (ak) at position 67 the amino acid residue is Z3 or Z4; (al) at position 60 the amino acid residue is Z5; and (am) at position 37 the amino acid residue is Z4 or Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred isolated or recombinant polynucleotides of the invention encode an amino acid sequence further comprising the amino acid residues in the amino acid sequence that correspond to the positions specified in (a)-(am), at least 90% conform to the amino acid residue restrictions specified in (a)-(am).

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the following restrictions: (a) at positions 1, 7, 9, 13, 20, 36, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the following restrictions: (a) at positions 1, 7, 9, 13, 20, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 36, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the following restrictions: (a) at positions 1, 7, 9, 20, 42, 50, 72, 75, 76, 78, 94, 98, 110, 121, and/or 141 the amino acid residue is Z1; (b) at positions 13, 46, 56, 70, 107, 117, and/or 118 the amino acid residue is Z2; (c) at positions 23, 55, 71, 77, 88, and/or 109 the amino acid residue is Z3; (d) at positions 16, 21, 41, 73, 85, 99, and/or 111 the amino acid residue is Z4; (e) at positions 34 and/or 95 the amino acid residue is Z5; (f) at position 22, 25, 29, 43, 44, 66, 74, 87, 102, 108, 116, 122, 127, 133, 134, 136, and/or 137 the amino acid residue is Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred isolated or recombinant polynucleotides of the invention encode an amino acid sequence further comprising at position 36 an amino acid residue selected from the group consisting of Z1 and Z3. Some preferred isolated or recombinant polynucleotides of the invention encode an amino acid sequence further comprising at position 64 an amino acid residue selected from the group consisting of Z1 and Z2.

Some preferred isolated or recombinant polynucleotides of the invention encode an amino acid sequence such that when the sequence is optimally aligned with SEQ ID NO: 300, 445, or 457, at least 80% of the amino acid residues in the amino acid sequence conform to the following restrictions: (a) at position 2 the amino acid residue is I or L; (b) at position 3 the amino acid residue is E; (c) at position 4 the amino acid residue is V or I; (d) at position 5 the amino acid residue is K; (e) at position 6 the amino acid residue is P; (f) at position 8 the amino acid residue is N; (g) at position 10 the amino acid residue is E; (h) at position 11 the amino acid residue is D or E; (i) at position 12 the amino acid residue is T; (j) at position 14 the amino acid residue is E or D; (k) at position 15 the amino acid residue is L; (l) at position 17 the amino acid residue is H; (m) at position 18 the amino acid residue is R, E or K; (n) at position 19 the amino acid residue is I or V; (o) at position 24 the amino acid residue is Q; (p) S at position 26 the amino acid residue is M, L, V or I; (q) at position 27 the amino acid residue is E; (r) at position 28 the amino acid residue is A or V; (s) at position 30 the amino acid residue is M; (t) at position 31 the amino acid residue is Y or F; (u) at position 32 the amino acid residue is E or D; (v) at position 33 the amino acid residue is T or S; (w) at position 35 the amino acid residue is L; (x) at position 37 the amino acid residue is R, G, E or Q; (y) at position 39 the amino acid residue is A or S; (z) at position 40 the amino acid residue is F or L; (aa) at position 45 the amino acid residue is Y or F; (ab) at position 47 the amino acid residue is R or G; (ac) at position 48 the amino acid residue is G; (ad) at position 49 the amino acid residue is K, R, or Q; (ae) at position 51 the amino acid residue is I or V; (af) at position 52 the amino acid residue is S; (ag) at position 53 the amino acid residue is I or V; (ah) at position 54 the amino acid residue is A; (ai) at position 57 the amino acid residue is H or N; (aj) at position 58 the amino acid residue is Q, K, R or P; (ak) at position 59 the amino acid residue is A; (al) at position 60 the amino acid residue is E; (am) at position 61 the amino acid residue is H or R; (an) at position 63 the amino acid residue is E or D; (ao) at position 65 the amino acid residue is E, P or Q; (ap) at position 67 the amino acid residue is Q or R; (aq) at position 68 the amino acid residue is K or E; (ar) at position 69 the amino acid residue is Q; (as) at position 79 the amino acid residue is E; (at) at position 80 the amino acid residue is G; (au) at position 81 the amino acid residue is Y, H or F; (av) at position 82 the amino acid residue is R; (aw) at position 83 the amino acid residue is E or D; (ax) at position 84 the amino acid residue is Q; (ay) at position 86 the amino acid residue is A; (az) at position 89 the amino acid residue is G, T or S; (ba) at position 90 the amino acid residue is L; (bb) at position 91 the amino acid residue is L, I or V; (bc) at position 92 the amino acid residue is R or K; (bd) at position 93 the amino acid residue is H; (be) at position 96 the amino acid residue is E or Q; (bf) at position 97 the amino acid residue is I; (bg) at position 100 the amino acid residue is K or N; (bh) at position 101 the amino acid residue is K or R; (bi) at position 103 the amino acid residue is A or V; (bj) at position 104 the amino acid residue is D; (bk) at position 105 the amino acid residue is M, L or I; (bl) at position 106 the amino acid residue is L; (bm) at position 112 the amino acid residue is T or A; (bn) at position 113 the amino acid residue is S or T; (bo) at position 114 the amino acid residue is A; (bp) at position 115 the amino acid residue is S; (bq) at position 119 the amino acid residue is K or R; (br) at position 120 the amino acid residue is K or R; (bs) at position 123 the amino acid residue is F or L; (bt) at position 125 the amino acid residue is E; (bu) at position 126 the amino acid residue is Q or H; (bv) at position 128 the amino acid residue is E or D; (bw) at position 129 the amino acid residue is V or I; (bx) at position 130 the amino acid residue is F; (by) at position 131 the amino acid residue is D or E; (bx) at position 132 the amino acid residue is T; (ca) at position 135 the amino acid residue is V; (cb) at position 138 the amino acid residue is H; (cc) at position 139 the amino acid residue is I; (cd) at position 140 the amino acid residue is L or M; (ce) at position 142 the amino acid residue is Y; (cf) at position 143 the amino acid residue is K or R; (cg) at position 145 the amino acid residue is L or I; and (ch) at position 146 the amino acid residue is T.

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the amino acid residue restrictions specified in (a)-(ch) above.

Some preferred isolated or recombinant polynucleotides of the invention encode an amino acid sequence that when optimally aligned with a reference amino acid sequence selected from the group consisting of SEQ ID NO: 300, 445, and 457 to generate a similarity score of at least 460 using the BLOSUM62 matrix, a gap existence penalty of 11, and a gap extension penalty of 1, one or more of the following positions conform to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P, further wherein of the amino acid residues in the amino acid sequence that correspond to the following positions, at least 80% conform to the following restrictions: (a) at positions 9, 76, 94 and 110 the amino acid residue is A; (b) at positions 29 and 108 the amino acid residue is C; (c) at position 34 the amino acid residue is D; (d) at position 95 the amino acid residue is E; (e) at position 56 the amino acid residue is F; (f) at positions 43, 44, 66, 74, 87, 102, 116, 122, 127 and 136 the amino acid residue is G; (g) at position 41 the amino acid residue is H; (h) at position 7 the amino acid residue is I; (i) at position 85 the amino acid residue is K; (j) at positions 20, 42, 50, 78 and 121 the amino acid residue is L; (k) at positions 1 and 141 the amino acid residue is M; (l) at positions 23 and 109 the amino acid residue is N; (m) at positions 22, 25, 133, 134 and 137 the amino acid residue is P; (n) at position 71 the amino acid residue is Q; (o) at positions 16, 21, 73, 99 and 111 the amino acid residue is R; (p) at position 55 the amino acid residue is S; (q) at position 77 the amino acid residue is T; (r) at position 107 the amino acid residue is W; and (s) at position 13, 46, 70 and 118 the amino acid residue is Y.

Some preferred isolated or recombinant polynucleotides of the invention encode an amino acid sequence which conforms to at least one of the following additional restrictions: (a) at position 36 the amino acid residue is M, L, or T; (b) at position 72 the amino acid residue is L or I; (c) at position 75 the amino acid residue is M or V; (d) at position 64 the amino acid residue is L, I, or F; (e) at position 88 the amino acid residue is T or S; (f) at position 117 the amino acid residue is Y or F.

Some preferred isolated or recombinant polynucleotides of the invention encode an amino acid sequence in which at least one of the following additional conditions is met: (a) at position 14 the amino acid residue is D; (b) at position 18 the amino acid residue is E; (c) at position 26 the amino acid residue is M or V; (e) at position 30 the amino acid residue is I; (f) at position 32 the amino acid residue is D; (g) at position 36 the amino acid residue is M or T; (i) at position 37 the amino acid residue is C; (j) at position 38 the amino acid residue is D; (j) at position 53 the amino acid residue is V; (k) at position 58 the amino acid residue is R; (l) at position 61 the amino acid residue is R; (m) at position 62 the amino acid residue is L; (n) at position 64 the amino acid residue is I or F; (o) at position 65 the amino acid residue is P; (p) at position 72 the amino acid residue is I; (q) at position 75 the amino acid residue is V; (r) at position 88 the amino acid residue is T; (s) at position 89 the amino acid residue is G; (t) at position 91 the amino acid residue is L; (u) at position 98 the amino acid residue is I; (v) at position 105 the amino acid residue I; (w) at position 112 the amino acid residue is A; (x) at position 124 the amino acid residue is G or C; (y) at position 128 the amino acid residue is D; (z) at position 140 the amino acid residue is M; (aa) at position 143 the amino acid residue is R; and (ab) at position 144 the amino acid residue is W.

Some preferred isolated or recombinant polynucleotides of the invention encode an amino acid sequence wherein, of the amino acid residues in the amino acid sequence that correspond to the positions specified in (a) through (ab) as described above, at least 80% conform to the amino acid residue restrictions specified in (a) through (ab).

Some preferred isolated or recombinant polynucleotides of the invention encode an amino acid sequence which conforms to at least one of the following additional restrictions: (a) at position 41 the amino acid residue is H; (b) at position 138 the amino acid residue is H; (c) at position 34 the amino acid residue is N; and (d) at position 55 the amino acid residue is S.

Some preferred isolated or recombinant polynucleotides of the invention are selected from the group consisting of: (a) a nucleotide sequence encoding an amino acid sequence that is at least 98% identical to SEQ ID NO:577; (b) a nucleotide sequence encoding an amino acid sequence that is at least 97% identical to SEQ ID NO:578; (c) a nucleotide sequence encoding an amino acid sequence that is at least 97% identical to SEQ ID NO:621; (d) a nucleotide sequence encoding an amino acid sequence that is at least 98% identical to SEQ ID NO:579; (e) a nucleotide sequence encoding an amino acid sequence that is at least 98% identical to SEQ ID NO:602; (f) a nucleotide sequence encoding an amino acid sequence that is at least 95% identical to SEQ ID NO:697; (g) a nucleotide sequence encoding an amino acid sequence that is at least 96% identical to SEQ ID NO:721; (h) a nucleotide sequence encoding an amino acid sequence that is at least 97% identical to SEQ ID NO:613; (i) a nucleotide sequence encoding an amino acid sequence that is at least 89% identical to SEQ ID NO:677; (j) a nucleotide sequence encoding an amino acid sequence that is at least 96% identical to SEQ ID NO:584; (k) a nucleotide sequence encoding an amino acid sequence that is at least 98% identical to SEQ ID NO:707; (l) a nucleotide sequence encoding an amino acid sequence that is at least 98% identical to SEQ ID NO:616; (m) a nucleotide sequence encoding an amino acid sequence that is at least 96% identical to SEQ ID NO:612; and (n) a nucleotide sequence encoding an amino acid sequence that is at least 98% identical to SEQ ID NO:590.

Some preferred isolated or recombinant polynucleotides of the invention are selected from the group consisting of: (a) a nucleotide sequence encoding an amino acid sequence that is at least 98% identical to SEQ ID NO:577; (b) a nucleotide sequence encoding an amino acid sequence that is at least 97% identical to SEQ ID NO:578; (c) a nucleotide sequence encoding an amino acid sequence that is at least 97% identical to SEQ ID NO:621; (d) a nucleotide sequence encoding an amino acid sequence that is at least 98% identical to SEQ ID NO:579; (e) a nucleotide sequence encoding an amino acid sequence that is at least 98% identical to SEQ ID NO:602; (f) a nucleotide sequence encoding an amino acid sequence that is at least 95% identical to SEQ ID NO:697; (g) a nucleotide sequence encoding an amino acid sequence that is at least 96% identical to SEQ ID NO:721; (h) a nucleotide sequence encoding an amino acid sequence that is at least 97% identical to SEQ ID NO:613; (i) a nucleotide sequence encoding an amino acid sequence that is at least 89% identical to SEQ ID NO:677; (j) a nucleotide sequence encoding an amino acid sequence that is at least 96% identical to SEQ ID NO:584; (k) a nucleotide sequence encoding an amino acid sequence that is at least 98% identical to SEQ ID NO:707; (l) a nucleotide sequence encoding an amino acid sequence that is at least 98% identical to SEQ ID NO:616; (m) a nucleotide sequence encoding an amino acid sequence that is at least 96% identical to SEQ ID NO:612; and (n) a nucleotide sequence encoding an amino acid sequence that is at least 98% identical to SEQ ID NO:590, wherein the following positions conform to the following restrictions: (i) at positions 18 and 38, there is a Z5 amino acid residue; (ii) at position 62, there is a Z1 amino acid residue; (iii) at position 124, there is a Z6 amino acid residue; and (iv) at position 144, there is a Z2 amino acid residue, wherein: Z1 is an amino acid residue selected from the group consisting of A, I, L, M, and V; Z2 is an amino acid residue selected from the group consisting of F, W, and Y; Z5 is an amino acid residue selected from the group consisting of D and E; and Z6 is an amino acid residue selected from the group consisting of C, G, and P.

Some preferred isolated or recombinant polynucleotides of the invention are selected from the group consisting of: (a) a nucleotide sequence encoding an amino acid sequence that is at least 98% identical to SEQ ID NO:577; (b) a nucleotide sequence encoding an amino acid sequence that is at least 97% identical to SEQ ID NO:578; (c) a nucleotide sequence encoding an amino acid sequence that is at least 97% identical to SEQ ID NO:621; (d) a nucleotide sequence encoding an amino acid sequence that is at least 98% identical to SEQ ID NO:579; (e) a nucleotide sequence encoding an amino acid sequence that is at least 98% identical to SEQ ID NO:602; (f) a nucleotide sequence encoding an amino acid sequence that is at least 95% identical to SEQ ID NO:697; (g) a nucleotide sequence encoding an amino acid sequence that is at least 96% identical to SEQ ID NO:721; (h) a nucleotide sequence encoding an amino acid sequence that is at least 97% identical to SEQ ID NO:613; (i) a nucleotide sequence encoding an amino acid sequence that is at least 89% identical to SEQ ID NO:677; (j) a nucleotide sequence encoding an amino acid sequence that is at least 96% identical to SEQ ID NO:584; (k) a nucleotide sequence encoding an amino acid sequence that is at least 98% identical to SEQ ID NO:707; (l) a nucleotide sequence encoding an amino acid sequence that is at least 98% identical to SEQ ID NO:616; (m) a nucleotide sequence encoding an amino acid sequence that is at least 96% identical to SEQ ID NO:612; and (n) a nucleotide sequence encoding an amino acid sequence that is at least 98% identical to SEQ ID NO:590, further wherein of the amino acid residues in the amino acid sequence that correspond to the following positions, at least 90% conform to the following restrictions: (a) at positions 2, 4, 15, 19, 26, 28, 31, 45, 51, 54, 86, 90, 91, 97, 103, 105, 106, 114, 123, 129, 139, and/or 145 the amino acid residue is B1; and (b) at positions 3, 5, 8, 10, 11, 14, 17, 24, 27, 32, 37, 47, 48, 49, 52, 57, 58, 61, 63, 68, 69, 79, 80, 82, 83, 89, 92, 100, 101, 104, 119, 120, 125, 126, 128, 131, and/or 143 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred isolated or recombinant polynucleotides of the invention are selected from the group consisting of: (a) a nucleotide sequence encoding an amino acid sequence that is at least 98% identical to SEQ ID NO:577; (b) a nucleotide sequence encoding an amino acid sequence that is at least 97% identical to SEQ ID NO:578; (c) a nucleotide sequence encoding an amino acid sequence that is at least 97% identical to SEQ ID NO:621; (d) a nucleotide sequence encoding an amino acid sequence that is at least 98% identical to SEQ ID NO:579; (e) a nucleotide sequence encoding an amino acid sequence that is at least 98% identical to SEQ ID NO:602; (f) a nucleotide sequence encoding an amino acid sequence that is at least 95% identical to SEQ ID NO:697; (g) a nucleotide sequence encoding an amino acid sequence that is at least 96% identical to SEQ ID NO:721; (h) a nucleotide sequence encoding an amino acid sequence that is at least 97% identical to SEQ ID NO:613; (i) a nucleotide sequence encoding an amino acid sequence that is at least 89% identical to SEQ ID NO:677; (j) a nucleotide sequence encoding an amino acid sequence that is at least 96% identical to SEQ ID NO:584; (k) a nucleotide sequence encoding an amino acid sequence that is at least 98% identical to SEQ ID NO:707; (l) a nucleotide sequence encoding an amino acid sequence that is at least 98% identical to SEQ ID NO:616; (m) a nucleotide sequence encoding an amino acid sequence that is at least 96% identical to SEQ ID NO:612; and (n) a nucleotide sequence encoding an amino acid sequence that is at least 98% identical to SEQ ID NO:590, and further wherein of the amino acid residues in the amino acid sequence that correspond to the following positions, at least 80% conform to the following restrictions: (a) at positions 2, 4, 15, 19, 26, 28, 51, 54, 86, 90, 91, 97, 103, 105, 106, 114, 129, 139, and/or 145 the amino acid residue is Z1; (b) at positions 31 and/or 45 the amino acid residue is Z2; (c) at position 8 the amino acid residue is Z3; (d) at position 89 the amino acid residue is Z3 or Z6; (e) at positions 82, 92, 101 and/or 120 the amino acid residue is Z4; (f) at positions 3, 11, 27 and/or 79 the amino acid residue is Z5; (g) at position 18 the amino acid residue is Z4 or Z5; (h) at position 123 the amino acid residue is Z1 or Z2; (i) at positions 12, 33, 35, 39, 53, 59, 112, 132, 135, 140, and/or 146 the amino acid residue is Z1 or Z3; (j) at position 30 the amino acid residue is Z1; (k) at position 6 the amino acid residue is Z6; (l) at position 81 the amino acid residue is Z2 or Z4; (m) at position 113 the amino acid residue is Z3; (n) at position 138 the amino acid residue is Z4; (o) at position 142 the amino acid residue is Z2; (p) at positions 57 and/or 126 the amino acid residue is Z3 or Z4; (q) at position 5, 17, and 61 the amino acid residue is Z4; (r) at position 24 the amino acid residue is Z3; (s) at position 104 the amino acid residue is Z5; (t) at positions 52, and/or 69 the amino acid residue is Z3; (u) at positions 14 and/or 119 the amino acid residue is Z5; (v) at positions 10, 32, 63, and/or 83 the amino acid residue is Z5; (w) at positions 48 and/or 80 the amino acid residue is Z6; (x) at position 40 the amino acid residue is Z1 or Z2; (y) at position 96 the amino acid residue is Z3 or Z5; (z) at position 65 the amino acid residue is Z3, Z4, or Z6; (aa) at positions 84 and/or 115 the amino acid residue is Z3; (ab) at position 93 the amino acid residue is Z4; (ac) at position 130 the amino acid residue is Z2; (ad) at position 58 the amino acid residue is Z3, Z4 or Z6; (ae) at position 47 the amino acid residue is Z4 or Z6; (af) at positions 49 and/or 100 the amino acid residue is Z3 or Z4; (ag) at position 68 the amino acid residue is Z4 or Z5; (ah) at position 143 the amino acid residue is Z4; (ai) at position 131 the amino acid residue is Z5; (aj) at positions 125 and/or 128 the amino acid residue is Z5; (ak) at position 67 the amino acid residue is Z3 or Z4; (al) at position 60 the amino acid residue is Z5; and (am) at position 37 the amino acid residue is Z4 or Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred isolated or recombinant polynucleotides of the invention encode an amino acid sequence further wherein of the amino acid residues in the amino acid sequence that correspond to the positions specified in (a)-(am), at least 90% conform to the amino acid residue restrictions specified in (a)-(am).

Some preferred isolated or recombinant polynucleotides of the invention encode an amino acid sequence in which of the amino acid residues in the amino acid sequence that correspond to the following positions, at least 90% conform to the following additional restrictions: (a) at positions 1, 7, 9, 13, 20, 36, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the following restrictions: (a) at positions 1, 7, 9, 13, 20, 42, 46, 50, 56, 64, 70, 72, 75, 76, 78, 94, 98, 107, 110, 117, 118, 121, and/or 141 the amino acid residue is B1; and (b) at positions 16, 21, 22, 23, 25, 29, 34, 36, 41, 43, 44, 55, 66, 71, 73, 74, 77, 85, 87, 88, 95, 99, 102, 108, 109, 111, 116, 122, 127, 133, 134, 136, and/or 137 the amino acid residue is B2; wherein B1 is an amino acid selected from the group consisting of A, I, L, M, F, W, Y, and V; and B2 is an amino acid selected from the group consisting of R, N, D, C, Q, E, G, H, K, P, S, and T.

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the following restrictions: (a) at positions 1, 7, 9, 20, 42, 50, 72, 75, 76, 78, 94, 98, 110, 121, and/or 141 the amino acid residue is Z1; (b) at positions 13, 46, 56, 70, 107, 117, and/or 118 the amino acid residue is Z2; (c) at positions 23, 55, 71, 77, 88, and/or 109 the amino acid residue is Z3; (d) at positions 16, 21, 41, 73, 85, 99, and/or 111 the amino acid residue is Z4; (e) at positions 34 and/or 95 the amino acid residue is Z5; (f) at position 22, 25, 29, 43, 44, 66, 74, 87, 102, 108, 116, 122, 127, 133, 134, 136, and/or 137 the amino acid residue is Z6; wherein Z1 is an amino acid selected from the group consisting of A, I, L, M, and V; Z2 is an amino acid selected from the group consisting of F, W, and Y; Z3 is an amino acid selected from the group consisting of N, Q, S, and T; Z4 is an amino acid selected from the group consisting of R, H, and K; Z5 is an amino acid selected from the group consisting of D and E; and Z6 is an amino acid selected from the group consisting of C, G, and P.

Some preferred isolated or recombinant polynucleotides of the invention encode an amino acid sequence further comprising at position 36 an amino acid residue selected from the group consisting of Z1 and Z3. Some preferred isolated or recombinant polynucleotides of the invention encode an amino acid sequence further comprising at position 64 an amino acid residue selected from the group consisting of Z1 and Z2.

Some preferred isolated or recombinant polynucleotides of the invention encode an amino acid sequence such that when the sequence is optimally aligned with SEQ ID NO: 300, 445, or 457, at least 80% of the amino acid residues in the amino acid sequence conform to the following restrictions: (a) at position 2 the amino acid residue is I or L; (b) at position 3 the amino acid residue is E; (c) at position 4 the amino acid residue is V or I; (d) at position 5 the amino acid residue is K; (e) at position 6 the amino acid residue is P; (f) at position 8 the amino acid residue is N; (g) at position 10 the amino acid residue is E; (h) at position 11 the amino acid residue is D or E; (i) at position 12 the amino acid residue is T; (j) at position 14 the amino acid residue is E or D; (k) at position 15 the amino acid residue is L; (l) at position 17 the amino acid residue is H; (m) at position 18 the amino acid residue is R, E or K; (n) at position 19 the amino acid residue is I or V; (o) at position 24 the amino acid residue is Q; (p) at position 26 the amino acid residue is M, L, V or I; (q) at position 27 the amino acid residue is E; (r) at position 28 the amino acid residue is A or V; (s) at position 30 the amino acid residue is M; (t) at position 31 the amino acid residue is Y or F; (u) at position 32 the amino acid residue is E or D; (v) at position 33 the amino acid residue is T or S; (w) at position 35 the amino acid residue is L; (x) at position 37 the amino acid residue is R, G, E or Q; (y) at position 39 the amino acid residue is A or S; (z) at position 40 the amino acid residue is F or L; (aa) at position 45 the amino acid residue is Y or F; (ab) at position 47 the amino acid residue is R or G; (ac) at position 48 the amino acid residue is G; (ad) at position 49 the amino acid residue is K, R, or Q; (ae) at position 51 the amino acid residue is I or V; (af) at position 52 the amino acid residue is S; (ag) at position 53 the amino acid residue is I or V; (ah) at position 54 the amino acid residue is A; (ai) at position 57 the amino acid residue is H or N; (aj) at position 58 the amino acid residue is Q, K, R or P; (ak) at position 59 the amino acid residue is A; (al) at position 60 the amino acid residue is E; (am) at position 61 the amino acid residue is H or R; (an) at position 63 the amino acid residue is E or D; (ao) at position 65 the amino acid residue is E, P or Q; (ap) at position 67 the amino acid residue is Q or R; (aq) at position 68 the amino acid residue is K or E; (ar) at position 69 the amino acid residue is Q; (as) at position 79 the amino acid residue is E; (at) at position 80 the amino acid residue is G; (au) at position 81 the amino acid residue is Y, H or F; (av) at position 82 the amino acid residue is R; (aw) at position 83 the amino acid residue is E or D; (ax) at position 84 the amino acid residue is Q; (ay) at position 86 the amino acid residue is A; (az) at position 89 the amino acid residue is G, T or S; (ba) at position 90 the amino acid residue is L; (bb) at position 91 the amino acid residue is L, I or V; (bc) at position 92 the amino acid residue is R or K; (bd) at position 93 the amino acid residue is H; (be) at position 96 the amino acid residue is E or Q; (bf) at position 97 the amino acid residue is I; (bg) at position 100 the amino acid residue is K or N; (bh) at position 101 the amino acid residue is K or R; (bi) at position 103 the amino acid residue is A or V; (bj) at position 104 the amino acid residue is D; (bk) at position 105 the amino acid residue is M, L or I; (bl) at position 106 the amino acid residue is L; (bm) at position 112 the amino acid residue is T or A; (bn) at position 113 the amino acid residue is S or T; (bo) at position 114 the amino acid residue is A; (bp) at position 115 the amino acid residue is S; (bq) at position 119 the amino acid residue is K or R; (br) at position 120 the amino acid residue is K or R; (bs) at position 123 the amino acid residue is F or L; (bt) at position 125 the amino acid residue is E; (bu) at position 126 the amino acid residue is Q or H; (bv) at position 128 the amino acid residue is E or D; (bw) at position 129 the amino acid residue is V or I; (bx) at position 130 the amino acid residue is F; (by) at position 131 the amino acid residue is D or E; (bx) at position 132 the amino acid residue is T; (ca) at position 135 the amino acid residue is V; (cb) at position 138 the amino acid residue is H; (cc) at position 139 the amino acid residue is I; (cd) at position 140 the amino acid residue is L or M; (ce) at position 142 the amino acid residue is Y; (cf) at position 143 the amino acid residue is K or R; (cg) at position 145 the amino acid residue is L or I; and (ch) at position 146 the amino acid residue is T.

Some preferred isolated or recombinant polynucleotides of the invention encode an amino acid sequence such that when the sequence is optimally aligned with SEQ ID NO: 300, 445, or 457, at least 90% of the amino acid residues in the amino acid sequence conform to the amino acid residue restrictions specified in (a)-(ch) above.

Some preferred isolated or recombinant polynucleotides of the invention are selected from the group consisting of: (a) a nucleotide sequence encoding an amino acid sequence that is at least 98% identical to SEQ ID NO:577; (b) a nucleotide sequence encoding an amino acid sequence that is at least 97% identical to SEQ ID NO:578; (c) a nucleotide sequence encoding an amino acid sequence that is at least 97% identical to SEQ ID NO:621; (d) a nucleotide sequence encoding an amino acid sequence that is at least 98% identical to SEQ ID NO:579; (e) a nucleotide sequence encoding an amino acid sequence that is at least 98% identical to SEQ ID NO:602; (f) a nucleotide sequence encoding an amino acid sequence that is at least 95% identical to SEQ ID NO:697; (g) a nucleotide sequence encoding an amino acid sequence that is at least 96% identical to SEQ ID NO:721; (h) a nucleotide sequence encoding an amino acid sequence that is at least 97% identical to SEQ ID NO:613; (i) a nucleotide sequence encoding an amino acid sequence that is at least 89% identical to SEQ ID NO:677; (j) a nucleotide sequence encoding an amino acid sequence that is at least 96% identical to SEQ ID NO:584; (k) a nucleotide sequence encoding an amino acid sequence that is at least 98% identical to SEQ ID NO:707; (l) a nucleotide sequence encoding an amino acid sequence that is at least 98% identical to SEQ ID NO:616; (m) a nucleotide sequence encoding an amino acid sequence that is at least 96% identical to SEQ ID NO:612; and (n) a nucleotide sequence encoding an amino acid sequence that is at least 98% identical to SEQ ID NO:590, and further wherein of the amino acid residues in the amino acid sequence that correspond to the following positions, at least 80% conform to the following restrictions: (a) at positions 9, 76, 94 and 110 the amino acid residue is A; (b) at positions 29 and 108 the amino acid residue is C; (c) at position 34 the amino acid residue is D; (d) at position 95 the amino acid residue is E; (e) at position 56 the amino acid residue is F; (f) at positions 43, 44, 66, 74, 87, 102, 116, 122, 127 and 136 the amino acid residue is G; (g) at position 41 the amino acid residue is H; (h) at position 7 the amino acid residue is I; (i) at position 85 the amino acid residue is K; (j) at positions 20, 42, 50, 78 and 121 the amino acid residue is L; (k) at positions 1 and 141 the amino acid residue is M; (l) at positions 23 and 109 the amino acid residue is N; (m) at positions 22, 25, 133, 134 and 137 the amino acid residue is P; (n) at position 71 the amino acid residue is Q; (o) at positions 16, 21, 73, 99 and 111 the amino acid residue is R; (p) at position 55 the amino acid residue is S; (q) at position 77 the amino acid residue is T; (r) at position 107 the amino acid residue is W; and (s) at position 13, 46, 70 and 118 the amino acid residue is Y.

Some preferred isolated or recombinant polynucleotides of the invention encode an amino acid sequence further comprising at least one amino acid residue that meets the following criteria: (a) at position 14 the amino acid residue is D; (b) at position 18 the amino acid residue is E; (c) at position 26 the amino acid residue is M or V; (e) at position 30 the amino acid residue is I; (f) at position 32 the amino acid residue is D; (g) at position 36 the amino acid residue is M or T; (i) at position 37 the amino acid residue is C; (j) at position 38 the amino acid residue is D; (j) at position 53 the amino acid residue is V; (k) at position 58 the amino acid residue is R; (l) at position 61 the amino acid residue is R; (m) at position 62 the amino acid residue is L; (n) at position 64 the amino acid residue is I or F; (o) at position 65 the amino acid residue is P; (p) at position 72 the amino acid residue is I; (q) at position 75 the amino acid residue is V; (r) at position 88 the amino acid residue is T; (s) at position 89 the amino acid residue is G; (t) at position 91 the amino acid residue is L; (u) at position 98 the amino acid residue is I; (v) at position 105 the amino acid residue I; (w) at position 112 the amino acid residue is A; (x) at position 124 the amino acid residue is G or C; (y) at position 128 the amino acid residue is D; (z) at position 140 the amino acid residue is M; (aa) at position 143 the amino acid residue is R; and (ab) at position 144 the amino acid residue is W.

Some preferred isolated or recombinant polynucleotides of the invention encode an amino acid sequence such that when the sequence is optimally aligned with SEQ ID NO: 300, 445, or 457, at least 80% of the amino acid residues in the amino acid sequence conform to the amino acid residue restrictions specified in (a) through (ab) above.

Some preferred isolated or recombinant polynucleotides of the invention comprise a nucleotide sequence which encodes an amino acid sequence selected from the group consisting of: (a) an amino acid sequence that is at least 96% identical to SEQ ID NO:919 (such as, for example, a nucleotide sequence which encodes SEQ ID NO:917, 919, 921, 923, 925, 927, 833, 835, 839, 843, 845, 859, 863, 873, 877, 891, 895, 901, 905, 907, 913, 915, or 950); (b) an amino acid sequence that is at least 97% identical to SEQ ID NO:929 (such as, for example, a nucleotide sequence which encodes SEQ ID NO:929, 931, 835, 843, 849, or 867); (c) an amino acid sequence that is at least 98% identical to SEQ ID NO:847 (such as, for example, a nucleotide sequence which encodes SEQ ID NO:845 or 847); (d) an amino acid sequence that is at least 98% identical to SEQ ID NO:851; (e) an amino acid sequence that is at least 98% identical to SEQ ID NO:853; (f) an amino acid sequence that is at least 98% identical to SEQ ID NO:855 (such as, for example, a nucleotide sequence which encodes SEQ ID NO:835 or 855); (g) an amino acid sequence that is at least 98% identical to SEQ ID NO:857; (h) an amino acid sequence that is at least 98% identical to SEQ ID NO:861 (such as, for example, a nucleotide sequence which encodes SEQ ID NO:839, 861, or 883); (i) an amino acid sequence that is at least 98% identical to SEQ ID NO:871; (j) an amino acid sequence that is at least 98% identical to SEQ ID NO:875; (k) an amino acid sequence that is at least 98% identical to SEQ ID NO:881; (l) an amino acid sequence that is at least 98% identical to SEQ ID NO:885 (such as, for example, a nucleotide sequence which encodes SEQ ID NO:845 or 885); (m) an amino acid sequence that is at least 98% identical to SEQ ID NO:887; (n) an amino acid sequence that is at least 98% identical to SEQ ID NO:889 (such as, for example, a nucleotide sequence which encodes SEQ ID NO: 863, 889, 891, or 903); (o) an amino acid sequence that is at least 98% identical to SEQ ID NO:893; (p) an amino acid sequence that is at least 98% identical to SEQ ID NO:897; (q) an amino acid sequence that is at least 98% identical to SEQ ID NO:899; (r) an amino acid sequence that is at least 98% identical to SEQ ID NO:909 (such as, for example, a nucleotide sequence which encodes SEQ ID NO:883 or 909); (s) an amino acid sequence that is at least 98% identical to SEQ ID NO:911; (t) an amino acid sequence that is at least 99% identical to SEQ ID NO:837; (u) an amino acid sequence that is at least 99% identical to SEQ ID NO:841; (v) an amino acid sequence that is at least 99% identical to SEQ ID NO:865; (w) an amino acid sequence that is at least 99% identical to SEQ ID NO:869; and (x) an amino acid sequence that is at least 99% identical to SEQ ID NO:879.

Some preferred isolated or recombinant polynucleotides of the invention are selected from the group consisting of: (a) a nucleotide sequence encoding an amino acid sequence that is at least 96% identical to SEQ ID NO:919 (for example, a nucleotide sequence such as SEQ ID NO:916, 918, 920, 922, 924, 926, 832, 834, 838, 842, 844, 858, 862, 872, 876, 890, 894, 900, 904, 906, 912, 914, 939, 940, 941, 942, 943, 944, 949, 951 or 952); (b) a nucleotide sequence encoding an amino acid sequence that is at least 97% identical to SEQ ID NO:929 (for example, a nucleotide sequence such as SEQ ID NO:928, 930, 834, 842, 848, 866, 936 or 937); (c) a nucleotide sequence encoding an amino acid sequence that is at least 98% identical to SEQ ID NO:847 (for example, a nucleotide sequence such as SEQ ID NO:844 or 846); (d) a nucleotide sequence encoding an amino acid sequence that is at least 98% identical to SEQ ID NO:851 (for example, a nucleotide sequence such as SEQ ID NO:850); (e) a nucleotide sequence encoding an amino acid sequence that is at least 98% identical to SEQ ID NO:853 (for example, a nucleotide sequence such as SEQ ID NO:852); (f) a nucleotide sequence encoding an amino acid sequence that is at least 98% identical to SEQ ID NO:855 (for example, a nucleotide sequence such as SEQ ID NO:834 or 854); (g) a nucleotide sequence encoding an amino acid sequence that is at least 98% identical to SEQ ID NO:857 (for example, a nucleotide sequence such as SEQ ID NO:856); (h) a nucleotide sequence encoding an amino acid sequence that is at least 98% identical to SEQ ID NO:861 (for example, a nucleotide sequence such as SEQ ID NO:838, 860, or 882); (i) a nucleotide sequence encoding an amino acid sequence that is at least 98% identical to SEQ ID NO:871 (for example, a nucleotide sequence such as SEQ ID NO:870); (j) a nucleotide sequence encoding an amino acid sequence that is at least 98% identical to SEQ ID NO:875 (for example, a nucleotide sequence such as SEQ ID NO:874); (k) a nucleotide sequence encoding an amino acid sequence that is at least 98% identical to SEQ ID NO:881 (for example, a nucleotide sequence such as SEQ ID NO:880); (l) a nucleotide sequence encoding an amino acid sequence that is at least 98% identical to SEQ ID NO:885 (for example, a nucleotide sequence such as SEQ ID NO:844 or 884); (m) a nucleotide sequence encoding an amino acid sequence that is at least 98% identical to SEQ ID NO:887 (for example, a nucleotide sequence such as SEQ ID NO:886); (n) a nucleotide sequence encoding an amino acid sequence that is at least 98% identical to SEQ ID NO:889 (for example, a nucleotide sequence such as SEQ ID NO: 862, 888, 890, or 902); (o) a nucleotide sequence encoding an amino acid sequence that is at least 98% identical to SEQ ID NO:893 (for example, a nucleotide sequence such as SEQ ID NO:892); (p) a nucleotide sequence encoding an amino acid sequence that is at least 98% identical to SEQ ID NO:897 (for example, a nucleotide sequence such as SEQ ID NO:896); (q) a nucleotide sequence encoding an amino acid sequence that is at least 98% identical to SEQ ID NO:899 (for example, a nucleotide sequence such as SEQ ID NO:898); (r) a nucleotide sequence encoding an amino acid sequence that is at least 98% identical to SEQ ID NO:909 (for example, a nucleotide sequence such as SEQ ID NO:882 or 908); (s) a nucleotide sequence encoding an amino acid sequence that is at least 98% identical to SEQ ID NO:911 (for example, a nucleotide sequence such as SEQ ID NO:910); (t) a nucleotide sequence encoding an amino acid sequence that is at least 99% identical to SEQ ID NO:837 (for example, a nucleotide sequence such as SEQ ID NO:836); (u) a nucleotide sequence encoding an amino acid sequence that is at least 99% identical to SEQ ID NO:841 (for example, a nucleotide sequence such as SEQ ID NO:840); (v) a nucleotide sequence encoding an amino acid sequence that is at least 99% identical to SEQ ID NO:865 (for example, a nucleotide sequence such as SEQ ID NO:864); (w) a nucleotide sequence encoding an amino acid sequence that is at least 99% identical to SEQ ID NO:869 (for example, a nucleotide sequence such as SEQ ID NO:868); and (x) a nucleotide sequence encoding an amino acid sequence that is at least 99% identical to SEQ ID NO:879 (for example, a nucleotide sequence such as SEQ ID NO:878).

Some preferred isolated or recombinant polynucleotides of the invention comprise a nucleotide sequence encoding an amino acid sequence that is at least 95% identical to SEQ ID NO:929 and which comprises a Gly or an Asn residue at the amino acid position corresponding to position 33 of SEQ ID NO:929 (such as, for example, a nucleotide sequence which encodes SEQ ID NO:837,849,893,897,905,921,927,929 or 931). Some preferred isolated or recombinant polynucleotides of the invention comprise a nucleotide sequence encoding an amino acid sequence that is at least 95% identical to SEQ ID NO:929 and which comprises a Gly or an Asn residue at the amino acid position corresponding to position 33 of SEQ ID NO:929 (for example, a nucleotide sequence such as SEQ ID NO: 836, 848, 892, 896, 904, 920, 926, 928, 930, 938).

Some preferred isolated or recombinant polynucleotides of the invention encode an amino acid sequence which further comprises one or more amino acid residues meeting the following criteria: (a) at position 41 the amino acid residue is H; (b) at position 138 the amino acid residue is H; (c) at position 34 the amino acid residue is N; and (d) at position 55 the amino acid residue is S.

While description of the polypeptides of the invention is sometimes expressed herein as a list of possible restrictions on what amino acid residues are found at particular positions, in some embodiments, a polypeptide of the invention meets all of a particular set of possible restrictions. That is, in some instances herein, a list of possible restrictions is expressed as a list of options joined by the conjunction "and/or," and in some embodiments, each such conjunction operates as an "and" rather than an "or." In some embodiments, possible restrictions which are expressed as alternate possibilities are all found in the polypeptide of the invention; this is only true where the alternate possibilities are not mutually exclusive.

Sequence Variations

It will be appreciated by those skilled in the art that due to the degeneracy of the genetic code, a multitude of nucleotide sequences encoding GAT polypeptides of the invention may be produced, some of which bear substantial identity to the nucleic acid sequences explicitly disclosed herein.

TABLE 1

Codon Table

| Amino acids | | | Codon |
|---|---|---|---|
| Alanine | Ala | A | GCA GCC GCG GCU |
| Cysteine | Cys | C | UGC UGU |
| Aspartic acid | Asp | D | GAC GAU |
| Glutamic acid | Glu | E | GAA GAG |
| Phenylalanine | Phe | F | UUC UUU |
| Glycine | Gly | G | GGA GGC GGG GGU |
| Histidine | His | H | CAC CAU |
| Isoleucine | Ile | I | AUA AUC AUU |
| Lysine | Lys | K | AAA AAG |
| Leucine | Leu | L | UUA UUG CUA CUC CUG CUU |
| Methionine | Met | M | AUG |
| Asparagine | Asn | N | AAC AAU |
| Proline | Pro | P | CCA CCC CCG CCU |
| Glutamine | Gln | Q | CAA CAG |
| Arginine | Arg | R | AGA AGG CGA CGC CGG CGU |
| Serine | Ser | S | AGC AGU UCA UCC UCG UCU |
| Threonine | Thr | T | ACA ACC ACG ACU |
| Valine | Val | V | GUA GUC GUG GUU |
| Tryptophan | Trp | W | UGG |
| Tyrosine | Tyr | Y | UAC UAU |

For instance, inspection of the codon table (Table 1) shows that codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that U in an RNA sequence corresponds to T in a DNA sequence.

Using as an example the nucleic acid sequence corresponding to nucleotides 1-15 of SEQ ID NO:1 (ATG ATT GAA GTC AAA (SEQ ID NO:826)), a silent variation of this sequence includes AGT ATC GAG GTG AAG (SEQ ID NO:827); both sequences encode the amino acid sequence MIEVK (SEQ ID NO:828), which corresponds to amino acids 1-5 of SEQ ID NO:6.

Such "silent variations" are one species of "conservatively modified variations," as discussed below. One of skill will recognize that each codon in a nucleic acid (except AUG, which is ordinarily the only codon for methionine) can be modified by standard techniques to encode a functionally identical polypeptide. Accordingly, each silent variation of a nucleic acid which encodes a polypeptide is implicit in any described sequence. The invention provides each and every possible variation of nucleic acid sequence encoding a polypeptide of the invention that could be made by selecting combinations based on possible codon choices. These combinations are made in accordance with the standard triplet genetic code (e.g., as set forth in Table 1) as applied to the nucleic acid sequence encoding a GAT homologue polypeptide of the invention. All such variations of every nucleic acid herein are specifically provided and described by consideration of the sequence in combination with the genetic code. Any variant can be produced as noted herein.

A group of two or more different codons that, when translated in the same context, all encode the same amino acid, are referred to herein as "synonymous codons." As described herein, in some aspects of the invention a GAT polynucleotide is engineered for optimized codon usage in a desired host organism, for example a plant host. The term "optimized" or "optimal" are not meant to be restricted to the very best possible combination of codons, but simply indicates that the coding sequence as a whole possesses an improved usage of codons relative to a precursor polynucleotide from which it was derived. Thus, in one aspect the invention provides a method for producing a GAT polynucleotide variant by replacing at least one parental codon in a nucleotide sequence with a synonymous codon that is preferentially used in a desired host organism, e.g., a plant, relative to the parental codon.

"Conservatively modified variations" or, simply, "conservative variations" of a particular nucleic acid sequence refers to those nucleic acids which encode identical or essentially identical amino acid sequences, or, where the nucleic acid does not encode an amino acid sequence, to essentially identical sequences. One of skill will recognize that individual substitutions, deletions or additions which alter, add or delete a single amino acid or a small percentage of amino acids (typically less than 5%, more typically less than 4%, 2% or 1%, or less) in an encoded sequence are "conservatively modified variations" where the alterations result in the deletion of an amino acid, addition of an amino acid, or substitution of an amino acid with a chemically similar amino acid.

Conservative substitution tables providing functionally similar amino acids are well known in the art. Table 2 sets forth six groups which contain amino acids that are "conservative substitutions" for one another.

TABLE 2

Conservative Substitution Groups

| | | | |
|---|---|---|---|
| 1 Alanine (A) | Serine (S) | Threonine (T) | |
| 2 Aspartic acid (D) | Glutamic acid (E) | | |
| 3 Asparagine (N) | Glutamine (Q) | | |
| 4 Arginine (R) | Lysine (K) | | |
| 5 Isoleucine (I) | Leucine (L) | Methionine (M) | Valine (V) |
| 6 Phenylalanine (F) | Tyrosine (Y) | Tryptophan (W) | |

Thus, "conservatively substituted variations" of a listed polypeptide sequence of the present invention include substitutions of a small percentage, typically less than 5%, more typically less than 2% and often less than 1%, of the amino acids of the polypeptide sequence, with a conservatively selected amino acid of the same conservative substitution group. Thus, a conservatively substituted variation of a polypeptide of the invention can contain 1, 2, 3, 4, 5, 6, 7, 8, 9, or 10 substitutions with a conservatively substituted variation of the same conservative substitution group.

For example, a conservatively substituted variation of the polypeptide identified herein as SEQ ID NO:6 will contain "conservative substitutions" according to the six groups defined above, in up to 7 residues (i.e., 5% of the amino acids) in the 146 amino acid polypeptide.

In a further example, if four conservative substitutions were localized in the region corresponding to amino acids 21 to 30 of SEQ ID NO:6, examples of conservatively substituted variations of this region,
RPN QPL EAC M (SEQ ID NO:829), include:
KPQ QPV ESC M (SEQ ID NO:830) and
KPN NPL DAC V (SEQ ID NO:831) and the like, in accordance with the conservative substitutions listed in Table 2 (in the above example, conservative substitutions are underlined). The listing of a protein sequence herein, in conjunction with the above substitution table, provides an express listing of all conservatively substituted proteins.

Finally, the addition of sequences which do not alter the encoded activity of a nucleic acid molecule, such as the addition of a non-functional or non-coding sequence, is a conservative variation of the basic nucleic acid.

One of skill will appreciate that many conservative variations of the nucleic acid constructs which are disclosed yield a functionally identical construct. For example, as discussed above, owing to the degeneracy of the genetic code, "silent substitutions" (i.e., substitutions in a nucleic acid sequence which do not result in an alteration in an encoded polypeptide) are an implied feature of every nucleic acid sequence which encodes an amino acid. Similarly, "conservative amino acid substitutions," in one or a few amino acids in an amino acid sequence are substituted with different amino acids with highly similar properties, are also readily identified as being highly similar to a disclosed construct. Such conservative variations of each disclosed sequence are a feature of the present invention.

Non-conservative modifications of a particular nucleic acid are those which substitute any amino acid not characterized as a conservative substitution. For example, any substitution which crosses the bounds of the six groups set forth in Table 2. These include substitutions of basic or acidic amino acids for neutral amino acids, (e.g., Asp, Glu, Asn, or Gln for Val, Ile, Leu or Met), aromatic amino acid for basic or acidic amino acids (e.g., Phe, Tyr or Trp for Asp, Asn, Glu or Gln) or any other substitution not replacing an amino acid with a like amino acid.

Nucleic Acid Hybridization

Nucleic acids "hybridize" when they associate, typically in solution. Nucleic acids hybridize due to a variety of well-characterized physico-chemical forces, such as hydrogen bonding, solvent exclusion, base stacking and the like. An extensive guide to the hybridization of nucleic acids is found in Tijssen (1993) *Laboratory Techniques in Biochemistry and Molecular Biology-Hybridization with Nucleic Acid Probes*, Part I, Chapter 2, "Overview of principles of hybridization and the strategy of nucleic acid probe assays," (Elsevier, New York ("Tijssen")), as well as in Ausubel, supra, Hames and Higgins (1995) *Gene Probes* 1, IRL Press at Oxford University Press, Oxford, England ("Hames and Higgins 1") and Hames and Higgins (1995) *Gene Probes* 2, IRL Press at Oxford University Press, Oxford, England ("Hames and Higgins 2") and provide details on the synthesis, labeling, detection and quantification of DNA and RNA, including oligonucleotides.

"Stringent hybridization wash conditions" in the context of nucleic acid hybridization experiments, such as Southern and northern hybridizations, are sequence dependent, and are different under different environmental parameters. An extensive guide to the hybridization of nucleic acids is found in Tijssen (1993), supra, and in Hames and Higgins 1 and Hames and Higgins 2, supra.

For purposes of the present invention, generally, "highly stringent" hybridization and wash conditions are selected to be about 5° C. or less lower than the thermal melting point ($T_m$) for the specific sequence at a defined ionic strength and pH (as noted below, highly stringent conditions can also be referred to in comparative terms). The $T_m$ is the temperature (under defined ionic strength and pH) at which 50% of the test sequence hybridizes to a perfectly matched probe. Very stringent conditions are selected to be equal to the $T_m$ for a particular probe.

The $T_m$ of a nucleic acid duplex indicates the temperature at which the duplex is 50% denatured under the given conditions and its represents a direct measure of the stability of the nucleic acid hybrid. Thus, the $T_m$ corresponds to the temperature corresponding to the midpoint in transition from helix to random coil and it depends on length, nucleotide composition, and ionic strength for long stretches of nucleotides.

After hybridization, unhybridized nucleic acid material can be removed by a series of washes, the stringency of which can be adjusted depending upon the desired results. Low stringency washing conditions (e.g., using higher salt and lower temperature) increase sensitivity, but can produce nonspecific hybridization signals and high background signals. Higher stringency conditions (e.g., using lower salt and higher temperature that is closer to the hybridization temperature) lowers the background signal, typically with only the specific signal remaining. See Rapley, R. and Walker, J. M. eds., *Molecular Biomethods Handbook* (Humana Press, Inc. 1998) (hereinafter "Rapley and Walker"), which is incorporated herein by reference in its entirety for all purposes.

The $T_m$ of a DNA-DNA duplex can be estimated using Equation 1 as follows:

$$T_m(° C.) = 81.5° C. + 16.6(\log_{10} M) + 0.41(\% G+C) - 0.72(\% f) - 500/n,$$

where M is the molarity of the monovalent cations (usually Na+), (% G+C) is the percentage of guanosine (G) and cytosine (C) nucleotides, (% f) is the percentage of formalize and n is the number of nucleotide bases (i.e., length) of the hybrid. See Rapley and Walker, supra.

The $T_m$ of an RNA-DNA duplex can be estimated by using Equation 2 as follows:

$$T_m(° C.) = 79.8° C. + 18.5(\log_{10} M) + 0.58(\% G+C) - 11.8(\% G+C)^2 - 0.56 (\% f) - 820/n,$$

where M is the molarity of the monovalent cations (usually Na+), (% G+C) is the percentage of guanosine (G) and cytosine (C) nucleotides, (% f) is the percentage of formamide and n is the number of nucleotide bases (i.e., length) of the hybrid. Id.

Equations 1 and 2 are typically accurate only for hybrid duplexes longer than about 100-200 nucleotides. Id.

The $T_m$ of nucleic acid sequences shorter than 50 nucleotides can be calculated as follows:

$$T_m(° C.) = 4(G+C) + 2(A+T),$$

where A (adenine), C, T (thymine), and G are the numbers of the corresponding nucleotides.

An example of stringent hybridization conditions for hybridization of complementary nucleic acids which have more than 100 complementary residues on a filter in a Southern or northern blot is 50% formalin with 1 mg of heparin at 42° C., with the hybridization being carried out overnight. An example of stringent wash conditions is a 0.2×SSC wash at 65° C. for 15 minutes (see Sambrook, supra for a description of SSC buffer). Often the high stringency wash is preceded by a low stringency wash to remove background probe signal. An example low stringency wash is 2×SSC at 40° C. for 15 minutes.

In general, a signal to noise ratio of 2.5×-5× (or higher) than that observed for an unrelated probe in the particular hybridization assay indicates detection of a specific hybridization. Detection of at least stringent hybridization between two sequences in the context of the present invention indicates relatively strong structural similarity or homology to, e.g., the nucleic acids of the present invention provided in the sequence listings herein.

As noted, "highly stringent" conditions are selected to be about 5° C. or less lower than the thermal melting point ($T_m$) for the specific sequence at a defined ionic strength and pH. Target sequences that are closely related or identical to the nucleotide sequence of interest (e.g., "probes") can be identified under highly stringent conditions. Lower stringency conditions are appropriate for sequences that are less complementary. See, e.g., Rapley and Walker, supra.

Comparative hybridization can be used to identify nucleic acids of the invention, and this comparative hybridization method is a preferred method of distinguishing nucleic acids of the invention. Detection of highly stringent hybridization between two nucleotide sequences in the context of the present invention indicates relatively strong structural similarity/homology to, e.g., the nucleic acids provided in the sequence listing herein. Highly stringent hybridization between two nucleotide sequences demonstrates a degree of similarity or homology of structure, nucleotide base composition, arrangement or order that is greater than that detected by stringent hybridization conditions. In particular, detection of highly stringent hybridization in the context of the present invention indicates strong structural similarity or structural homology (e.g., nucleotide structure, base composition, arrangement or order) to, e.g., the nucleic acids provided in the sequence listings herein. For example, it is desirable to identify test nucleic acids that hybridize to the exemplar nucleic acids herein under stringent conditions.

Thus, one measure of stringent hybridization is the ability to hybridize to one of the listed nucleic acids (e.g., nucleic acid sequences SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952, and complementary polynucleotide sequences thereof), under highly stringent conditions (or very stringent conditions, or ultra-high stringency hybridization conditions, or ultra-ultra high stringency hybridization conditions). Stringent hybridization (as well as highly stringent, ultra-high stringency, or ultra-ultra high stringency hybridization conditions) and wash conditions can easily be determined empirically for any test nucleic acid. For example, in determining highly stringent hybridization and wash conditions, the hybridization and wash conditions are gradually increased (e.g., by increasing temperature, decreasing salt concentration, increasing detergent concentration and/or increasing the concentration of organic solvents, such as formalin, in the hybridization or wash), until a selected set of criteria are met. For example, the hybridization and wash conditions are gradually increased until a probe comprising one or more nucleic acid sequences selected from SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818; 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952, and complementary polynucleotide sequences thereof, binds to a perfectly matched complementary target (again, a nucleic acid comprising one or more nucleic acid sequences selected from SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952, and complementary polynucleotide sequences thereof), with a signal to noise ratio that is at least about 2.5×, and optionally about 5× or more as high as that observed for hybridization of the probe to an unmatched target. In this case, the unmatched target is a nucleic acid corresponding to a nucleic acid (other than those in the accompanying sequence listing) that is present in a public database such as GenBank™ at the time of filing of the subject application. Such sequences can be identified in GenBank by one of skill. Examples include Accession Nos. Z99109 and Y09476. Additional such sequences can be identified in e.g., GenBank, by one of ordinary skill in the art.

A test nucleic acid is said to specifically hybridize to a probe nucleic acid when it hybridizes at least ½ as well to the probe as to the perfectly matched complementary target, i.e., with a signal to noise ratio at least ½ as high as hybridization of the probe to the target under conditions in which the perfectly matched probe binds to the perfectly matched complementary target with a signal to noise ratio that is at least about 2×-10×, and occasionally 20×, 50× or greater than that observed for hybridization to any of the unmatched polynucleotides of Accession Nos. Z99109 and Y09476.

Ultra high-stringency hybridization and wash conditions are those in which the stringency of hybridization and wash conditions are increased until the signal to noise ratio for binding of the probe to the perfectly matched complementary target nucleic acid is at least 10× as high as that observed for hybridization to any of the unmatched target nucleic acids of Genbank Accession numbers Z99109 and Y09476. A target nucleic acid which hybridizes to a probe under such conditions, with a signal to noise ratio of at least ½ that of the perfectly matched complementary target nucleic acid is said to bind to the probe under ultra-high stringency conditions.

Similarly, even higher levels of stringency can be determined by gradually increasing the hybridization and/or wash conditions of the relevant hybridization assay. For example, those in which the stringency of hybridization and wash conditions are increased until the signal to noise ratio for binding of the probe to the perfectly matched complementary target nucleic acid is at least 10×, 20×, 50×, 100×, or 500× or more as high as that observed for hybridization to any of the unmatched target nucleic acids of Genbank Accession numbers Z99109 and Y09476. A target nucleic acid which hybridizes to a probe under such conditions, with a signal to noise ratio of at least ½ that of the perfectly matched complementary target nucleic acid is said to bind to the probe under ultra-ultra-high stringency conditions.

Target nucleic acids which hybridize to the nucleic acids represented by SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952 under high, ultra-high and ultra-ultra high stringency conditions are a feature of the invention. Examples of such nucleic acids include those with one or a few silent or conservative nucleic acid substitutions as compared to a given nucleic acid sequence.

Nucleic acids which do not hybridize to each other under stringent conditions are still substantially identical if the polypeptides which they encode are substantially identical. This occurs, e.g., when a copy of a nucleic acid is created using the maximum codon degeneracy permitted by the genetic code, or when antisera or antiserum generated against one or more of SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 946, 948, 950, 953, 954, 955, 956, 957, 958, 959, 960, 961, 962, 963, 964, 965, 966, 967, 968, 969, 970, 971, and 972, which has been subtracted using the polypeptides encoded by known nucleotide sequences, including those of Genbank Accession number CAA70664. Further details on immunological identification of polypeptides of the invention are found below. Additionally, for distinguishing between duplexes with sequences of less than about 100 nucleotides, a TMAC1 hybridization procedure known to those of ordinary skill in the art can be used. See, e.g., Sorg, U. et al. *Nucleic Acids Res.* (Sep. 11, 1991) 19(17), incorporated herein by reference in its entirety for all purposes.

In one aspect, the invention provides a nucleic acid which comprises a unique subsequence in a nucleic acid selected from SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952 against the complete set of nucleic acids represented by GenBank accession numbers Z99109 and Y09476 or other related sequences available in public databases as of the filing date of the subject application. Alignment can be performed using the BLAST algorithm set to default parameters. Any unique subsequence is useful, e.g., as a probe to identify the nucleic acids of the invention.

Similarly, the invention includes a polypeptide which comprises a unique subsequence in a polypeptide selected from: SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 946, 948, 950, 953, 954, 955, 956, 957, 958, 959, 960, 961, 962, 963, 964, 965, 966, 967, 968, 969, 970, 971, and 972. Here, the unique subsequence is unique as compared to a polypeptide corresponding to that of GenBank accession number CAA70664. Here again, the polypeptide is aligned against the sequences represented by accession number CAA70664. Note that if the sequence corresponds to a non-translated sequence such as a pseudo gene, the corresponding polypeptide is generated simply by in silico translation of the nucleic acid sequence into an amino acid sequence, where the reading frame is selected to correspond to the reading frame of homologous GAT polynucleotides.

The invention also provides for target nucleic acids which hybridize under stringent conditions to a unique coding oligonucleotide which encodes a unique subsequence in a polypeptide selected from SEQ ID NO: 568, 569, 570, 571, 572, 573, 574, 575, 576, 577, 578, 579, 580, 581, 582, 583, 584, 585, 586, 587, 588, 589, 590, 591, 592, 593, 594, 595, 596, 597, 598, 599, 600, 601, 602, 603, 604, 605, 606, 607, 608, 609, 610, 611, 612, 613, 614, 615, 616, 617, 618, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 946, 948, 950, 953, 954, 955, 956, 957, 958, 959, 960, 961, 962, 963, 964, 965, 966, 967, 968, 969, 970, 971, and 972 wherein the unique subsequence is unique as compared to a polypeptide corresponding to any of the control polypeptides. Unique sequences are determined as noted above.

In one example, the stringent conditions are selected such that a perfectly complementary oligonucleotide to the coding oligonucleotide hybridizes to the coding oligonucleotide with at least about a 2.5×-10× higher, preferably at least about a 5-10× higher signal to noise ratio than for hybridization of the perfectly complementary oligonucleotide to a control nucleic acid corresponding to any of the control polypeptides. Conditions can be selected such that higher ratios of signal to noise are observed in the particular assay which is used, e.g., about 15×, 20×, 30×, 50× or more. In this example, the target nucleic acid hybridizes to the unique coding oligonucleotide with at least a 2× higher signal to noise ratio as compared to hybridization of the control nucleic acid to the coding oligonucleotide. Again, higher signal to noise ratios can be selected, e.g., about 2.5×, 5×, 10×, 20×, 30×, 50× or more. The particular signal will depend on the label used in the relevant assay, e.g., a fluorescent label, a calorimetric label, a radioactive label, or the like.

Vectors, Promoters and Expression Systems.

The present invention also includes recombinant constructs comprising one or more of the nucleic acid sequences as broadly described above. The constructs comprise a vector, such as, a plasmid, a cosmid, a phage, a virus, a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

As previously discussed, general texts which describe molecular biological techniques useful herein, including the use of vectors, promoters and many other relevant topics, include Berger and Kimmel, *Guide to Molecular Cloning Techniques, Methods in Enzymology* Volume 152, (Academic Press, Inc., San Diego, Calif.) ("Berger"); Sambrook et al., *Molecular Cloning—A Laboratory Manual*, 2d ed., Vol. 1-3, Cold Spring Harbor Laboratory, Cold Spring Harbor, N.Y., 1989 ("Sambrook") and *Current Protocols in Molecular Biology*, F. M. Ausubel et al., eds., Current Protocols, a joint venture between Greene Publishing Associates, Inc. and John Wiley & Sons, Inc., (supplemented through 1999) ("Ausubel"). Examples of protocols sufficient to direct persons of skill through in vitro amplification methods, including the polymerase chain reaction (PCR), the ligase chain reaction (LCR), Qβ-replicase amplification and other RNA polymerase mediated techniques (e.g., NASBA), e.g., for the production of the homologous nucleic acids of the invention are found in Berger, Sambrook, and Ausubel, as well as in Mullis et al. (1987) U.S. Pat. No. 4,683,202; Innis et al., eds. (1990) *PCR Protocols: A Guide to Methods and Applications* (Academic Press Inc. San Diego, Calif.) ("Innis"); Arnheim & Levinson (Oct. 1, 1990) *C&EN* 36-47; *The Journal Of NIH Research* (1991) 3: 81-94; Kwoh et al. (1989) *Proc. Natl. Acad. Sci. USA* 86: 1173; Guatelli et al. (1990) *Proc. Nat'l. Acad. Sci. USA* 87: 1874; Lomell et al. (1989) *J. Clin. Chem* 35: 1826; Landegren et al. (1988) *Science* 241: 1077-1080; Van Brunt (1990) *Biotechnology* 8: 291-294; Wu and Wallace (1989) *Gene* 4:560; Barringer et al. (1990) *Gene* 89:117; and Sooknanan and Malek (1995) *Biotechnology* 13: 563-564. Improved methods for cloning in vitro amplified nucleic acids are described in Wallace et al., U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

The present invention also relates to engineered host cells that are transduced (transformed or transfected) with a vector of the invention (e.g., an invention cloning vector or an invention expression vector), as well as the production of polypeptides of the invention by recombinant techniques. The vector may be, for example, a plasmid, a viral particle, a phage, etc. The engineered host cells can be cultured in conventional nutrient media modified as appropriate for activating promoters, selecting transformants, or amplifying the GAT homologue gene. Culture conditions, such as temperature, pH and the like, are those previously used with the host cell selected for expression, and will be apparent to those skilled in the art and in the references cited herein, including, e.g., Sambrook, Ausubel and Berger, as well as e.g., Freshney (1994) *Culture of Animal Cells: A Manual of Basic Technique*, 3$^{rd}$ ed. (Wiley-Liss, New York) and the references cited therein.

GAT polypeptides of the invention can be produced in non-animal cells such as plants, yeast, fungi, bacteria and the like. In addition to Sambrook, Berger and Ausubel, details regarding non-animal cell culture can be found in Payne et al. (1992) *Plant Cell and Tissue Culture in Liquid Systems* (John Wiley & Sons, Inc. New York, N.Y.); Gamborg and Phillips, eds. (1995) *Plant Cell, Tissue and Organ Culture: Fundamental Methods/Springer Lab Manual* (Springer-Verlag, Berlin); and Atlas and Parks, eds., *The Handbook of Microbiological Media* (1993) CRC Press, Boca Raton, Fla.

Polynucleotides of the present invention can be incorporated into any one of a variety of expression vectors suitable for expressing a polypeptide. Suitable vectors include chromosomal, nonchromosomal and synthetic DNA sequences, e.g., derivatives of SV40; bacterial plasmids; phage DNA; baculovirus; yeast plasmids; vectors derived from combinations of plasmids and phage DNA, viral DNA such as vaccinia, adenovirus, fowl pox virus, pseudorabies, adenovirus, adeno-associated viruses, retroviruses and many others. Any vector that transduces genetic material into a cell, and, if replication is desired, which is replicable and viable in the relevant host can be used.

When incorporated into an expression vector, a polynucleotide of the invention is operatively linked to an appropriate transcription control sequence (promoter) to direct mRNA synthesis. Examples of such transcription control sequences particularly suited for use in transgenic plants include the cauliflower mosaic virus (CaMV), figwort mosaic virus (FMV) and strawberry vein banding virus (SVBV) promoters, described in U.S. Provisional Application No. 60/245,354. Other promoters known to control expression of genes in prokaryotic or eukaryotic cells or their viruses and which can be used in some embodiments of the invention include SV40 promoter, *E. coli* lac or trp promoter, and the phage lambda PL promoter. An expression vector optionally contains a ribosome binding site for translation initiation, and a transcription terminator, such as PinII. The vector also optionally includes appropriate sequences for amplifying expression, e.g., an enhancer.

In addition, the expression vectors of the present invention optionally contain one or more selectable marker genes to provide a phenotypic trait for selection of transformed host cells. Usually, the selectable marker gene will encode antibiotic or herbicide resistance. Suitable genes include those coding for resistance to the antibiotic spectinomycin or streptomycin (e.g., the aada gene), the streptomycin phosphotransferase (SPT) gene coding for streptomycin resistance, the neomycin phosphotransferase (NPTII) gene encoding kanamycin or geneticin resistance, the hygromycin phosphotransferase (HPT) gene coding for hygromycin resistance. Additional selectable marker genes include dihydrofolate reductase or neomycin resistance for eukaryotic cell culture, and tetracycline or ampicillin resistance in *E. coli.*

Suitable genes coding for resistance to herbicides include those which act to inhibit the action of acetolactate synthase (ALS), in particular the sulfonylurea-type herbicides (e.g., the acetolactate synthase (ALS) gene containing mutations leading to such resistance in particular the S4 and/or Hra mutations), those which act to inhibit the action of glutamine synthase, such as phosphinothricin or basta (e.g., the bar gene), or other such genes known in the art. The bar gene encodes resistance to the herbicide basta and the ALS gene encodes resistance to the herbicide chlorsulfuron. In some instances, the modified GAT genes are used as selectable markers.

Vectors of the present invention can be employed to transform an appropriate host to permit the host to express an inventive protein or polypeptide. Examples of appropriate expression hosts include: bacterial cells, such as *E. coli, B. subtilis, Streptomyces,* and *Salmonella typhimurium*; fungal cells, such as *Saccharomyces cerevisiae, Pichia pastoris,* and *Neurospora crassa*; insect cells such as *Drosophila* and *Spodoptera frugiperda*; mammalian cells such as CHO, COS, BHK, HEK 293 br Bowes melanoma; or plant cells or explants, etc. It is understood that not all cells or cell lines need to be capable of producing fully functional GAT polypeptides; for example, antigenic fragments of a GAT polypeptide may be produced. The present invention is not limited by the host cells employed.

In bacterial systems, a number of expression vectors may be selected depending upon the use intended for the GAT polypeptide. For example, when large quantities of GAT polypeptide or fragments thereof are needed for commercial production or for induction of antibodies, vectors which direct high level expression of fusion proteins that are readily purified can be desirable. Such vectors include, but are not limited to, multifunctional *E. coli* cloning and expression vectors such as BLUESCRIPT (Stratagene), in which the GAT polypeptide coding sequence may be ligated into the vector in-frame with sequences for the amino-terminal Met and the subsequent 7 residues of beta-galactosidase so that a hybrid protein is produced; pIN vectors (Van Heeke & Schuster (1989) *J. Biol. Chem.* 264: 5503-5509); pET vectors (Novagen, Madison Wis.); and the like.

Similarly, in the yeast *Saccharomyces cerevisiae* a number of vectors containing constitutive or inducible promoters such as alpha factor, alcohol oxidase and PGH may be used for production of the GAT polypeptides of the invention. For reviews, see Ausubel (supra) and Grant et al. (1987) *Methods in Enzymology* 153:516-544.

In mammalian host cells, a variety of expression systems, including viral-based systems, may be utilized. In cases where an adenovirus is used as an expression vector, a coding sequence, e.g., of a GAT polypeptide, is optionally ligated into an adenovirus transcription/translation complex consisting of the late promoter and tripartite leader sequence. Insertion of a GAT polypeptide coding region into a nonessential E1 or E3 region of the viral genome will result in a viable virus capable of expressing a GAT in infected host cells (Logan and Shenk (1984) *Proc. Nat'l. Acad. Sci. USA* 81:3655-3659). In addition, transcription enhancers, such as the rous sarcoma virus (RSV) enhancer, may be used to increase expression in mammalian host cells.

Similarly, in plant cells, expression can be driven from a transgene integrated into a plant chromosome, or cytoplasmically from an episomal or viral nucleic acid. In the case of stably integrated transgenes, it is often desirable to provide sequences capable of driving constitutive or inducible expression of the GAT polynucleotides of the invention, for example, using viral, e.g., CaMV, or plant derived regulatory sequences. Numerous plant derived regulatory sequences have been described, including sequences which direct expression in a tissue specific manner, e.g., TobRB7, patatin B33, GRP gene promoters, the rbcS-3A promoter, and the like. Alternatively, high level expression can be achieved by transiently expressing exogenous sequences of a plant viral vector, e.g., TMV, BMV, etc. Typically, transgenic plants constitutively expressing a GAT polynucleotide of the invention will be preferred, and the regulatory sequences are selected to insure constitutive stable expression of the GAT polypeptide.

Typical vectors useful for expression of nucleic acids in higher plants are well known in the art and include vectors derived from the tumor-inducing (Ti) plasmid of *Agrobacterium tumefaciens* described by Rogers et al. (1987) *Meth. Enzymol.* 153: 253-277. Exemplary *A. tumefaciens* vectors useful herein are plasmids pKYLX6 and pKYLX7 of Schardl et al. (1987) *Gene* 61:1-11 and Berger et al. (1989) *Proc. Nat'l. Acad. Sci. U.S.A.* 86: 8402-8406. Another useful vector herein is plasmid pBI101.2 that is available from Clontech Laboratories, Inc. (Palo Alto, Calif.). A variety of plant viruses that can be employed as vectors are known in the art and include cauliflower mosaic virus (CaMV), geminivirus, brome mosaic virus, and tobacco mosaic virus.

In some embodiments of the present invention, a GAT polynucleotide construct suitable for transformation of plant cells is prepared. For example, a desired GAT polynucleotide can be incorporated into a recombinant expression cassette to facilitate introduction of the gene into a plant and subsequent expression of the encoded polypeptide. An expression cassette will typically comprise a GAT polynucleotide, or functional fragment thereof, operably linked to a promoter sequence and other transcriptional and translational initiation regulatory sequences which will direct expression of the sequence in the intended tissues (e.g., entire plant, leaves, seeds) of the transformed plant.

For example, a strongly or weakly constitutive plant promoter can be employed which will direct expression of the GAT polypeptide in all tissues of a plant. Such promoters are active under most environmental conditions and states of development or cell differentiation. Examples of constitutive promoters include the cauliflower mosaic virus (CaMV) 35S transcription initiation region, the 1'—or 2'—promoter derived from T-DNA of *Agrobacterium tumefaciens*, the ubiquitin 1 promoter, the Smas promoter, the cinnamyl alcohol dehydrogenase promoter (U.S. Pat. No. 5,683,439), the Nos promoter, the pEmu promoter, the rubisco promoter, the GRP1-8 promoter and other transcription initiation regions from various plant genes known to those of skill. In situations in which over expression of a GAT polynucleotide is detrimental to the plant or otherwise undesirable, one of skill, upon review of this disclosure, will recognize that weak constitutive promoters can be used for low-levels of expression. In those cases where high levels of expression is not harmful to the plant, a strong promoter, e.g., a t-RNA or other pol III promoter, or a strong pol II promoter, such as the cauliflower mosaic virus promoter, can be used.

Alternatively, a plant promoter may be under environmental control. Such promoters are referred to here as "inducible" promoters. Examples of environmental conditions that may effect transcription by inducible promoters include pathogen attack, anaerobic conditions, or the presence of light. In particular, examples of inducible promoters are the Adh1 promoter which is inducible by hypoxia or cold stress, the Hsp70 promoter which is inducible by heat stress, and the PPDK promoter which is inducible by light. Also useful are promoters which are chemically inducible.

The promoters used in the present invention can be "tissue-specific" and, as such, under developmental control in that the polynucleotide is expressed only in certain tissues, such as leaves, roots, fruit, flowers and/or seeds. An exemplary promoter is the anther specific promoter 5126 (U.S. Pat. Nos. 5,689,049 and 5,689,051). Examples of seed-preferred promoters include, but are not limited to, 27 kD gamma zein promoter and waxy promoter, Boronat et al. 1986) *Plant Sci.* 47, 95-102; Reina et al. (1990) *Nucleic Acids Res.* 18 (21): 6426; and Kloesgen et al. (1986) *Mol. Gen. Genet.* 203: 237-244. Promoters that express in the embryo, pericarp, and endosperm are disclosed in U.S. Patent Application Ser. No. 60/097,233 filed Aug. 20, 1998 and 60/098,230 filed Aug. 28, 1998. The disclosures each of these are incorporated herein by reference in their entirety. In embodiments in which one or more nucleic acid sequences endogenous to the plant system are incorporated into the construct, the endogenous promoters (or variants thereof) from these genes can be employed for directing expression of the genes in the transfected plant. Tissue-specific promoters can also be used to direct expression of heterologous polynucleotides.

In general, the particular promoter used in the expression cassette in plants depends on the intended application. Either heterologous or non-heterologous (i.e., endogenous) promoters can be employed to direct expression of the nucleic acids of the present invention. These promoters can also be used, for example, in expression cassettes to drive expression of antisense nucleic acids to reduce, increase, or alter the concentration and/or composition of the proteins of the present invention in a desired tissue. Any of a number of promoters which direct transcription in plant cells are suitable. The promoter can be either constitutive or inducible. In addition to the promoters noted above, promoters of bacterial origin which operate in plants include the octopine synthase promoter, the nopaline synthase promoter and other promoters derived from native Ti plasmids (see, Herrara-Estrella et al. (1983) *Nature* 303: 209-213). Viral promoters include the 35S and 19S RNA promoters of cauliflower mosaic virus (Odell et al. (1985) *Nature* 313: 810-812). Other plant promoters include the ribulose-1,3-bisphosphate carboxylase small subunit promoter and the phaseolin promoter. The promoter sequence from the E8 gene and other genes may also be used. The isolation and sequence of the E8 promoter is described in detail in Deikman and Fischer (1988) *EMBO J.* 7: 3315-3327.

To identify candidate promoters, the 5' portions of a genomic clone is analyzed for sequences characteristic of promoter sequences. For instance, promoter sequence elements include the TATA box consensus sequence (TATAAT), which is usually 20 to 30 base pairs upstream of the transcription start site. In plants, further upstream from the TATA box, at positions –80 to –100, there is typically a promoter element with a series of adenines surrounding the trinucleotide G (or T) as described by Messing et al. (1983) *Genetic Engineering in Plants*, eds. Kosage, et al., pp. 221-227.

In preparing polynucleotide constructs, e.g., vectors, of the invention, sequences other than the promoter and the cojoined polynucleotide can also be employed. If normal polypeptide expression is desired, a polyadenylation region at the 3'-end of a GAT-encoding region can be included. The polyadenylation region can be derived, for example, from a variety of plant genes, or from T-DNA. The 3' end sequence to be added can be derived from, for example, the nopaline synthase or octopine synthase genes, or alternatively from another plant gene, or less preferably from any other eukaryotic gene.

An intron sequence can be added to the 5' untranslated region of the coding sequence or the partial coding sequence to increase the amount of the mature message that accumulates. See for example Buchman and Berg (1988) *Mol. Cell Biol.* 8: 4395-4405 and Callis et al. (1987) *Genes Dev.* 1: 1183-1200. Use of maize introns Adh1, intron 1, 2, and 6, and the Bronze-1 intron are known in the art. See generally, Freeling and Walbot, eds. (1994) *The Maize Handbook* (Springer, New York), chapter 116.

The construct can also include a marker gene which confers a selectable phenotype on plant cells. For example, the marker may encode biocide tolerance, particularly antibiotic tolerance, such as tolerance to kanamycin, G418, bleomycin, hygromycin, or herbicide tolerance, such as tolerance to chlorsulfuron, or phosphinothricin (the active ingredient in the herbicides bialaphos and Basta).

Specific initiation signals can aid in efficient translation of a GAT polynucleotide-encoding sequence of the present invention. These signals can include, e.g., the ATG initiation codon and adjacent sequences. In cases where a GAT polypeptide-encoding sequence, its initiation codon and upstream sequences are inserted into an appropriate expression vector, no additional translational control signals may be needed. However, in cases where only the coding sequence (e.g., a mature protein coding sequence), or a portion thereof, is inserted, exogenous transcriptional control signals including the initiation codon must be provided. Furthermore, the initiation codon must be in the correct reading frame to ensure transcription of the entire insert. Exogenous transcriptional elements and initiation codons can be of various origins, both natural and synthetic. The efficiency of expression may be enhanced by the inclusion of enhancers appropriate to the cell system in use (Scharf et al. (1994) *Results Probl. Cell Differ.* 20: 125-62 and Bittner et al. (1987) *Methods in Enzymol* 153: 516-544).

Secretion/Localization Sequences

Polynucleotides of the invention can also be fused, for example, in-frame to nucleic acids encoding a secretion/localization sequence, to target polypeptide expression to a desired cellular compartment, membrane, or organelle of a host cell, or to direct polypeptide secretion to the periplasmic space or into the cell culture media. Such sequences are known to those of skill, and include secretion leader peptides, organelle targeting sequences (e.g., nuclear localization sequences, ER retention signals, mitochondrial transit sequences, and chloroplast transit sequences), membrane localization/anchor sequences (e.g., stop transfer sequences, GPI anchor sequences), and the like.

In a preferred embodiment, a polynucleotide of the invention is fused in frame with an N-terminal chloroplast transit sequence (or chloroplast transit peptide sequence) derived from a gene encoding a polypeptide that is normally targeted to the chloroplast. Such sequences are typically rich in serine and threonine; are deficient in aspartate, glutamate, and tyrosine; and generally have a central domain rich in positively charged amino acids.

Expression Hosts

In a further embodiment, the present invention relates to host cells containing the above-described constructs. The host cell can be a eukaryotic cell, such as a mammalian cell, a yeast cell, or a plant cell, or the host cell can be a prokaryotic cell, such as a bacterial cell. Introduction of the construct into the host cell can be effected by calcium phosphate transfection, DEAE-Dextran mediated transfection, electroporation, or other common techniques (Davis et al., *Basic Methods in Molecular Biology*).

A host cell is optionally chosen for its ability to modulate the expression of the inserted sequences or to process the expressed protein in the desired fashion. Such modifications of the protein include, but are not limited to, acetylation, carboxylation, glycosylation, phosphorylation, lipidation and acylation. Post-translational processing that cleaves a "pre" or a "prepro" form of the protein may also be important for correct insertion, folding and/or function. Different host cells such as *E. coli, Bacillus* sp., yeast or mammalian cells such as CHO, HeLa, BHK, MDCK, 293, WI38, etc. have specific cellular machinery and characteristic mechanisms, e.g., for post-translational activities and may be chosen to ensure the desired modification and processing of the introduced, foreign protein.

For long-term, high-yield production of recombinant proteins, stable expression systems can be used. For example, plant cells, explants or tissues, e.g. shoots, or leaf discs, which stably express a polypeptide of the invention are transduced using expression vectors which contain viral origins of replication or endogenous expression elements and a selectable marker gene. Following the introduction of the vector, cells may be allowed to grow for a period determined to be appropriate for the cell type, e.g., 1 or more hours for bacterial cells, 1-4 days for plant cells, 2-4 weeks for some plant explants, in an enriched media before they are switched to selective media. The purpose of the selectable marker is to confer resistance to selection, and its presence allows growth and recovery of cells which successfully express the introduced sequences. For example, transgenic plants expressing the polypeptides of the invention can be selected directly for resistance to the herbicide, glyphosate. Resistant embryos derived from stably transformed explants can be proliferated, e.g., using tissue culture techniques appropriate to the cell type.

Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing GAT polynucleotides of the invention can be designed with signal sequences which direct secretion of the mature polypeptides through a prokaryotic or eukaryotic cell membrane.

Additional Polypeptide Sequences

Polynucleotides of the present invention may also comprise a coding sequence fused in-frame to a marker sequence that, e.g., facilitates purification of the encoded polypeptide. Such purification facilitating domains include, but are not limited to, metal chelating peptides such as histidine-tryptophan modules that allow purification on immobilized metals, a sequence which binds glutathione (e.g., GST), a hemagglutinin (HA) tag (corresponding to an epitope derived from the influenza hemagglutinin protein; Wilson et al. (1984) *Cell* 37: 767), maltose binding protein sequences, the FLAG epitope utilized in the FLAGS extension/affinity purification system (Immunex Corp, Seattle, Wash.), and the like. The inclusion of a protease-cleavable polypeptide linker sequence between the purification domain and the GAT homologue sequence is useful to facilitate purification. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography, as described in Porath et al. (1992) *Protein Expression and Purification* 3: 263-281) while the enterokinase cleavage site provides a means for separating the GAT homologue polypeptide from the fusion protein. pGEX vectors (Promega; Madison, Wis.) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Polypeptide Production and Recovery

Following transduction of a suitable host and growth of the host cells to an appropriate cell density, the selected promoter is induced by appropriate means (e.g., temperature shift or chemical induction) and cells are cultured for an additional period. Cells are typically harvested by centrifugation, disrupted by physical or chemical means, and the resulting crude extract retained for further purification. Microbial cells employed in the expression of proteins can be disrupted by any convenient method, including freeze-thaw cycling, sonication, mechanical disruption, or use of cell lysing agents, or other methods, which are well known to those skilled in the art.

As noted, many references are available for the culture and production of many cells, including cells of bacterial, plant, animal (especially mammalian) and archebacterial origin. See e.g., Sambrook, Ausubel, and Berger (all supra), as well as Freshney (1994) *Culture of Animal Cells: A Manual of Basic Technique*, $3^{rd}$ ed. (Wiley-Liss, New York) and the references cited therein; Doyle and Griffiths (1997) *Mammalian Cell Culture: Essential Techniques* (John Wiley and Sons, NY); Humason (1979) *Animal Tissue Techniques*, $4^{th}$ ed. (W.H. Freeman and Company); and Ricciardelli, et al. (1989) *In vitro Cell Dev. Biol.* 25: 1016-1024. For plant cell culture and regeneration see, Payne et al. (1992) *Plant Cell and Tissue Culture in Liquid Systems* (John Wiley & Sons, Inc., New York, N.Y.); Gamborg and Phillips, eds. (1995) *Plant Cell, Tissue and Organ Culture: Fundamental Methods/Springer Lab Manual* (Springer-Verlag, Berlin); Jones, ed. (1984) *Plant Gene Transfer and Expression Protocols* (Humana Press, Totowa, N.J.); and Croy, ed. (1993) *Plant Molecular Biology* (Bios Scientific Publishers, Oxford, U.K.), ISBN 0 12 198370 6. Cell culture media in general are set forth in Atlas and Parks, eds. (1993) *The Handbook of Microbiological Media* (CRC Press, Boca Raton, Fla.). Additional information for cell culture is found in available commercial literature such as the *Life Science Research Cell Culture Catalogue* (1998) from Sigma-Aldrich, Inc. (St Louis, Mo.) ("Sigma-LSRCCC") and, e.g., *The Plant Culture Catalogue* and supplement (1997) also from Sigma-Aldrich, Inc. (St Louis, Mo.) ("Sigma-PCCS"). Further details regarding plant cell transformation and transgenic plant production are found below.

Polypeptides of the invention can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, affinity chromatography (e.g., using any of the tagging systems noted herein), hydroxylapatite chromatography, and lectin chromatography. Protein refolding steps can be used, as desired, in completing the configuration of the mature protein. Finally, high performance liquid chromatography (HPLC) can be employed in the final purification steps. In addition to the references noted supra, a variety of purification methods are well known in the art, including, e.g., those set forth in Sandana (1997) *Bioseparation of Proteins* (Academic Press, Inc.; Bollag et al. (1996) *Protein Methods*, $2^{nd}$ ed. (Wiley-Liss, NY); Walker (1996) *The Protein Protocols Handbook* (Humana Press, NJ), Harris and Angal (1990) *Protein Purfication Applications: A Practical Approach* (IRL Press at Oxford, Oxford, England); Harris and Angal *Protein Purification Methods: A Practical Approach* (IRL Press at Oxford, Oxford, England); Scopes (1993) *Protein Purification: Principles and Practice*, $3^{rd}$ ed. (Springer Verlag, NY); Janson and Ryden (1998) *Protein Purification: Principles, High Resolution Methods and Applications*, $2^{nd}$ ed. (Wiley-VCH, NY); and Walker (1998) *Protein Protocols on CD-ROM* (Humana Press, NJ).

In some cases, it is desirable to produce the GAT polypeptide of the invention in a large scale suitable for industrial and/or commercial applications. In such cases bulk fermentation procedures are employed. Briefly, a GAT polynucleotide, e.g., a polynucleotide comprising any one of SEQ ID NO: 516, 517, 518, 519, 520, 521, 522, 523, 524, 525, 526, 527, 528, 529, 530, 531, 532, 533, 534, 535, 536, 537, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952, or other nucleic acids encoding GAT polypeptides of the invention can be cloned into an expression vector. For example, U.S. Pat. No. 5,955, 310 to Widner et al. "METHODS FOR PRODUCING A POLYPEPTIDE IN A BACILLUS CELL," describes a vector with tandem promoters, and stabilizing sequences operably linked to a polypeptide encoding sequence. After inserting the polynucleotide of interest into a vector, the vector is transformed into a bacterial, e.g., a *Bacillus subtilis* strain PL1801IIE (amyE, apr, npr, spoIIE::Tn917) host. The introduction of an expression vector into a *Bacillus* cell may, for instance, be effected by protoplast transformation (see, e.g., Chang and Cohen (1979) *Mol. Gen. Genet.* 168:111), by using competent cells (see, e.g., Young and Spizizin (1961) *J. Bacteriol.* 81:823, or Dubnau and Davidoff-Abelson (1971) *J. Mol. Biol.* 56: 209), by electroporation (see, e.g., Shigekawa and Dower (1988) *Biotechniques* 6: 742), or by conjugation (see, e.g., Koehler and Thorne (1987) *J. Bacteriol.* 169: 5271), see also, Ausubel, Sambrook and Berger, all supra.

The transformed cells are cultivated in a nutrient medium suitable for production of the polypeptide using methods that are known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). The secreted polypeptide can be recovered directly from the medium.

The resulting polypeptide may be isolated by methods known in the art. For example, the polypeptide may be isolated from the nutrient medium by conventional procedures including, but not limited to, centrifugation, filtration, extraction, spray-drying, evaporation, or precipitation. The isolated polypeptide may then be further purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), or extraction (see, e.g., Bollag et al. (1996) *Protein Methods*, $2^{nd}$ ed. (Wiley-Liss, NY) and Walker (1996) *The Protein Protocols Handbook* (Humana Press, NJ).

Cell-free transcription/translation systems can also be employed to produce polypeptides using DNAs or RNAs of the present invention. Several such systems are commercially available. A general guide to in vitro transcription and translation protocols is found in Tymms (1995) *In vitro Transcription and Translation Protocols: Methods in Molecular Biology* (Garland Publishing, NY), vol. 37.

Substrates and Formats for Sequence Recombination

The polynucleotides of the invention are optionally used as substrates for a variety of diversity generating procedures, e.g., mutation, recombination and recursive recombination reactions, in addition to their use in standard cloning methods as set forth in, e.g., Ausubel, Berger and Sambrook, to produce additional GAT polynucleotides and polypeptides with desired properties. A variety of diversity generating protocols are available and described in the art. The procedures can be used separately, and/or in combination to produce one or more variants of a polynucleotide or set of polynucleotides, as well variants of encoded proteins. Individually and collectively, these procedures provide robust, widely applicable ways of generating diversified polynucleotides and sets of polynucleotides (including, e.g., polynucleotide libraries) useful, e.g., for the engineering or rapid evolution of polynucleotides, proteins, pathways, cells and/or organisms with new and/or improved characteristics. The process of altering the sequence can result in, for example, single nucleotide substitutions, multiple nucleotide substitutions, and insertion or deletion of regions of the nucleic acid sequence.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more polynucleotides, which can be selected or screened for polynucleotides that encode proteins with or which confer desirable properties. Following diversification by one or more of the methods described herein, or otherwise available to one of skill, any polynucleotides that are produced can be selected for a desired activity or property, e.g. altered $K_m$ for glyphosate, altered $K_m$ for acetyl CoA, use of alternative cofactors (e.g., propionyl CoA) increased $k_{cat}$, etc. This can include identifying any activity that can be detected, for example, in an automated or automatable format, by any of the assays in the art. For example, GAT homologs with increased specific activity can be detected by assaying the conversion of glyphosate to N-acetylglyphosate, e.g., by mass spectrometry. Alternatively, improved ability to confer resistance to glyphosate can be assayed by growing bacteria transformed with a nucleic acid of the invention on agar containing increasing concentrations of glyphosate or by spraying transgenic plants incorporating a nucleic acid of the invention with glyphosate. A variety of related (or even unrelated) properties can be evaluated, in serial or in parallel, at the discretion of the practitioner. Additional details regarding recombination and selection for herbicide tolerance can be found, e.g., in "DNA SHUFFLING TO PRODUCE HERBICIDE RESISTANT CROPS" (U.S. Pub. No. 2002/0058249) filed Aug. 12, 1999.

Descriptions of a variety of diversity generating procedures, including multigene shuffling and methods for generating modified nucleic acid sequences encoding multiple enzymatic domains, are found the following publications and the references cited therein: Soong, N. et al. (2000) *Nat. Genet.* 25(4): 436-39; Stemmer, et al. (1999) *Tumor Targeting* 4: 1-4; Ness et al. (1999) *Nature Biotech.* 17:893-896; Chang et al. (1999) *Nature Biotech.* 17: 793-797; Minshull and Stemmer (1999) *Current Opinion in Chemical Biology* 3: 284-290; Christians et al. (1999) *Nature Biotech.* 17: 259-264; Crameri et al. (1998) *Nature* 391: 288-291; Crameri et al. (1997) *Nature Biotech.* 15: 436-438; Zhang et al. (1997) *Proc. Nat'l. Acad. Sci. USA* 94: 4504-4509; Patten et al. (1997) *Current Opinion in Biotech.* 8: 724-733; Crameri et al. (1996) *Nature Med.* 2:100-103; Crameri et al. (1996) *Nature Biotech.* 14:315-319; Gates et al. (1996) *J. Mol. Biol.* 255: 373-386; Stemmer (1996) "Sexual PCR and Assembly PCR" in *The Encyclopedia of Molecular Biology* (VCH Publishers, New York) pp. 447-457; Crameri and Stemmer (1995) *BioTechniques* 18: 194-195; Stemmer et al., (1995) *Gene* 164: 49-53; Stemmer (1995) *Science* 270: 1510; Stemmer (1995) *Bio/Technology* 13: 549-553; Stemmer (1994) *Nature* 370: 389-391; and Stemmer (1994) *Proc. Nat'l Acad. Sci. USA* 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods Mol. Biol. 57:369-374; Smith (1985) "*In vitro* mutagenesis" Ann. Rev. Genet. 19:423-462; Botstein & Shortle (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller & Smith (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100: 468-500; and Zoller & Smith (1987) "Oligonucleotide-directed mutagenesis: a simple method using two oligonucleotide primers and a single-stranded DNA template" Methods in Enzymol. 154:329-350); phosphorothioate-modified DNA mutagenesis (Taylor et al. (1985) "The use of phosphorothioate-modified DNA in restriction enzyme reactions to prepare nicked DNA" Nucl. Acids Res. 13: 8749-8764; Taylor et al. (1985) "The rapid generation of oligonucleotide-directed mutations at high frequency using phosphorothioate-modified DNA" Nucl. Acids Res. 13: 8765-8787; Nakamaye & Eckstein (1986) "Inhibition of restriction endonuclease Nci I cleavage by phosphorothioate groups and its application to oligonucleotide-directed mutagenesis" Nucl. Acids Res. 14: 9679-9698; Sayers et al. (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer et al. (1988) "Improved enzymatic in vitro reactions in the gapped duplex DNA approach to oligonucleotide-directed construction of mutations" Nucl. Acids Res. 16: 7207; and Fritz et al. (1988) "Oligonucleotide-directed construction of mutations: a gapped duplex DNA procedure without enzymatic reactions in vitro" Nucl. Acids Res. 16: 6987-6999).

Additional suitable methods include point mismatch repair (Kramer et al. (1984) "Point Mismatch Repair" Cell 38:879-887), mutagenesis using repair-deficient host strains (Carter et al. (1985) "Improved oligonucleotide site-directed mutagenesis using M13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh & Henikoff (1986) "Use of oligonucleotides to generate large deletions" Nucl. Acids Res. 14: 5115), restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundström et al. (1985) "Oligonucleotide-directed mutagenesis by microscale 'shotgun' gene synthesis" Nucl. Acids Res. 13: 3305-3316); double-strand break repair (Mandecki (1986); Arnold (1993) "Protein engineering for unusual environments" *Current Opinion in Biotechnology* 4:450-455; and "Oligonucleotide-directed double-strand break repair in plasmids of *Escherichia coli*: a method for site-specific mutagenesis" *Proc. Natl. Acad. Sci. USA*, 83:7177-7181). Additional details on many of the above methods can be found in Methods in Enzymology Volume 154, which also describes useful controls for trouble-shooting problems with various mutagenesis methods.

Additional details regarding various diversity generating methods can be found in the following U.S. patents, PCT publications, and EPO publications: U.S. Pat. No. 5,605,793 to Stemmer (Feb. 25, 1997), "Methods for In vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/13487 by Stemmer et al., "Methods for Optimization of Gene Therapy by Recursive Sequence Shuffling and Selection;" WO 00/00632, "Methods for Generating Highly Diverse Libraries;" WO 00/09679, "Methods for Obtaining in vitro Recombined Polynucleotide Sequence Banks and Resulting Sequences;" WO 98/42832 by Arnold et al., "Recombination of Polynucleotide Sequences Using Random or Defined Primers;" WO 99/29902 by Arnold et al., "Method for Creating Polynucleotide and Polypeptide Sequences;" WO 98/41653 by Vind, "An in vitro Method for Construction of a DNA Library;" WO 98/41622 by Borchert et al., "Method for Constructing a Library Using DNA Shuffling;" WO 98/42727 by Pati and Zarling, "Sequence Alterations using Homologous Recombination;" WO 00/18906 by Patten et al., "Shuffling of Codon-Altered Genes;" WO 00/04190 by del Cardayre et al. "Evolution of Whole Cells and Organisms by Recursive Recombination;" WO 00/42561 by Crameri et al., "Oligonucleotide Mediated Nucleic Acid Recombination;" WO 00/42559 by Selifonov and Stemmer "Methods of Populating Data Structures for Use in Evolutionary Simulations;" WO 00/42560 by Selifonov et al., "Methods for Making Character Strings, Polynucleotides & Polypeptides Having Desired Characteristics;" WO 01/23401 by Welch et al., "Use of Codon-Varied Oligonucleotide Synthesis for Synthetic Shuffling;" and WO 01/64864 "Single-Stranded Nucleic Acid Template-Mediated Recombination and Nucleic Acid Fragment Isolation" by Affholter.

Certain U.S. applications provide additional details regarding various diversity generating methods, including "SHUFFLING OF CODON ALTERED GENES" by Patten et al. filed Sep. 28, 1999, (U.S. Ser. No. 09/407,800); "EVOLUTION OF WHOLE CELLS AND ORGANISMS BY RECURSIVE SEQUENCE RECOMBINATION", by del Cardayre et al. filed Jul. 15, 1998 (U.S. Ser. No. 09/166,188), and Jul. 15, 1999 (U.S. Pat. No. 6,379,964); "OLIGONUCLEOTIDE MEDIATED NUCLEIC ACID RECOMBINATION" by Crameri et al., filed Sep. 28, 1999 (U.S. Pat. No. 6,376,246); "OLIGONUCLEOTIDE MEDIATED NUCLEIC ACID RECOMBINATION" by Crameri et al., filed Jan. 18, 2000 (WO 00/42561); "USE OF CODON-BASED OLIGONUCLEOTIDE SYNTHESIS FOR SYNTHETIC SHUFFLING" by Welch et al., filed Sep. 28, 1999 (U.S. Pat. No. 6,436,675); "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (WO 00/42560); "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FOR USE IN EVOLUTIONARY SIMULATIONS" by Selifonov and Stemmer (WO 00/42559), filed Jan. 18, 2000; and "SINGLE-STRANDED NUCLEIC ACID TEMPLATE-MEDIATED RECOMBINATION AND NUCLEIC ACID FRAGMENT ISOLATION" by Affholter (U.S. Ser. No. 60/186,482, filed Mar. 2, 2000).

In brief, several different general classes of sequence modification methods, such as mutation, recombination, etc. are applicable to the present invention and set forth in the references above. That is, alterations to the component nucleic acid sequences to produced modified gene fusion constructs can be performed by any number of the protocols described, either before cojoining of the sequences, or after the cojoining step. The following exemplify some of the different types of preferred formats for diversity generation in the context of the present invention, including, e.g., certain recombination based diversity generation formats.

Nucleic acids can be recombined in vitro by any of a variety of techniques discussed in the references above, including e.g., DNAse digestion of nucleic acids to be recombined followed by ligation and/or PCR reassembly of the nucleic acids. For example, sexual PCR mutagenesis can be used in which random (or pseudo random,z or even non-random) fragmentation of the DNA molecule is followed by recombination, based on sequence similarity, between DNA molecules with different but related DNA sequences, in vitro, followed by fixation of the crossover by extension in a polymerase chain reaction. This process and many process variants is described in several of the references above, e.g., in Stemmer (1994) *Proc. Nat'l. Acad. Sci. USA* 91:10747-10751.

Similarly, nucleic acids can be recursively recombined in vivo, e.g., by allowing recombination to occur between nucleic acids in cells. Many such in vivo recombination formats are set forth in the references noted above. Such formats optionally provide direct recombination between nucleic acids of interest, or provide recombination between vectors, viruses, plasmids, etc., comprising the nucleic acids of interest, as well as other formats. Details regarding such procedures are found in the references noted above.

Whole genome recombination methods can also be used in which whole genomes of cells or other organisms are recombined, optionally including spiking of the genomic recombination mixtures with desired library components (e.g., genes corresponding to the pathways of the present invention). These methods have many applications, including those in which the identity of a target gene is not known. Details on such methods are found, e.g., in WO 98/31837 by del Cardayre et al. "Evolution of Whole Cells and Organisms by Recursive Sequence Recombination;" and in, e.g., WO 00/04190 by del Cardayre et al., also entitled "Evolution of Whole Cells and Organisms by Recursive Sequence Recombination." Thus, any of these processes and techniques for recombination, recursive recombination, and whole genome recombination, alone or in combination, can be used to generate the modified nucleic acid sequences and/or modified gene fusion constructs of the present invention.

Synthetic recombination methods can also be used, in which oligonucleotides corresponding to targets of interest are synthesized and reassembled in PCR or ligation reactions which include oligonucleotides which correspond to more than one parental nucleic acid, thereby generating new recombined nucleic acids. Oligonucleotides can be made by standard nucleotide addition methods, or can be made, e.g., by tri-nucleotide synthetic approaches. Details regarding such approaches are found in the references noted above, including, e.g., WO 00/42561 by Crameri et al., "Oligonucleotide Mediated Nucleic Acid Recombination;" WO 01/23401 by Welch et al., "Use of Codon-Varied Oligonucleotide Synthesis for Synthetic Shuffling;" WO 00/42560 by Selifonov et al., "Methods for Making Character Strings, Polynucleotides and Polypeptides Having Desired Characteristics;" and WO 00/42559 by Selifonov and Stemmer "Methods of Populating Data Structures for Use in Evolutionary Simulations."

In silico methods of recombination can be effected in which genetic algorithms are used in a computer to recombine sequence strings which correspond to homologous (or even non-homologous) nucleic acids. The resulting recombined sequence strings are optionally converted into nucleic acids by synthesis of nucleic acids which correspond to the recombined sequences, e.g., in concert with oligonucleotide synthesis gene reassembly techniques. This approach can generate random, partially random or designed variants. Many details regarding in silico recombination, including the use of genetic algorithms, genetic operators and the like in computer systems, combined with generation of corresponding nucleic acids (and/or proteins), as well as combinations of designed nucleic acids and/or proteins (e.g., based on crossover site selection) as well as designed, pseudo-random or random recombination methods are described in WO 00/42560 by Selifonov et al., "Methods for Making Character Strings, Polynucleotides and Polypeptides Having Desired Characteristics" and WO 00/42559 by Selifonov and Stemmer "Methods of Populating Data Structures for Use in Evolutionary Simulations." Extensive details regarding in silico recombination methods are found in these applications. This methodology is generally applicable to the present invention in providing for recombination of nucleic acid sequences and/or gene fusion constructs encoding proteins involved in various metabolic pathways (such as, for example, carotenoid biosynthetic pathways, ectoine biosynthetic pathways, polyhydroxyalkanoate biosynthetic pathways, aromatic polyketide biosynthetic pathways, and the like) in silico and/or the generation of corresponding nucleic acids or proteins.

Many methods of accessing natural diversity, e.g., by hybridization of diverse nucleic acids or nucleic acid fragments to single-stranded templates, followed by polymerization and/or ligation to regenerate full-length sequences, optionally followed by degradation of the templates and recovery of the resulting modified nucleic acids can be similarly used. In one method employing a single-stranded template, the fragment population derived from the genomic library(ies) is annealed with partial, or, often approximately full length ssDNA or RNA corresponding to the opposite strand. Assembly of complex chimeric genes from this population is then mediated by nuclease-base removal of non-hybridizing fragment ends, polymerization to fill gaps between such fragments and subsequent single stranded ligation. The parental polynucleotide strand can be removed by digestion (e.g., if RNA or uracil-containing), magnetic separation under denaturing conditions (if labeled in a manner conducive to such separation) and other available separation/purification methods. Alternatively, the parental strand is optionally co-purified with the chimeric strands and removed during subsequent screening and processing steps. Additional details regarding this approach are found, e.g., in "Single-Stranded Nucleic Acid Template-Mediated Recombination and Nucleic Acid Fragment Isolation" by Affholter, WO 01/64864.

In another approach, single-stranded molecules are converted to double-stranded DNA (dsDNA) and the dsDNA molecules are bound to a solid support by ligand-mediated binding. After separation of unbound DNA, the selected DNA molecules are released from the support and introduced into a suitable host cell to generate a library of enriched sequences which hybridize to the probe. A library produced in this manner provides a desirable substrate for further diversification using any of the procedures described herein.

Any of the preceding general recombination formats can be practiced in a reiterative fashion (e.g., one or more cycles of mutation/recombination or other diversity generation methods, optionally followed by one or more selection methods) to generate a more diverse set of recombinant nucleic acids.

Mutagenesis employing polynucleotide chain termination methods have also been proposed (see e.g., U.S. Pat. No. 5,965,408, "Method of DNA reassembly by interrupting synthesis" to Short, and the references above), and can be applied to the present invention. In this approach, double stranded DNAs corresponding to one or more genes sharing regions of sequence similarity are combined and denatured, in the presence or absence of primers specific for the gene. The single stranded polynucleotides are then annealed and incubated in the presence of a polymerase and a chain terminating reagent (e.g., ultraviolet, gamma or X-ray irradiation; ethidium bromide or other intercalators; DNA binding proteins, such as single strand binding proteins, transcription activating factors, or histones; polycyclic aromatic hydrocarbons; trivalent chromium or a trivalent chromium salt; or abbreviated polymerization mediated by rapid thermocycling; and the like), resulting in the production of partial duplex molecules. The partial duplex molecules, e.g., containing partially extended chains, are then denatured and reannealed in subsequent rounds of replication or partial replication resulting in polynucleotides which share varying degrees of sequence similarity and which are diversified with respect to the starting population of DNA molecules. Optionally, the products, or partial pools of the products, can be amplified at one or more stages in the process. Polynucleotides produced by a chain termination method, such as described above, are suitable substrates for any other described recombination format.

Diversity also can be generated in nucleic acids or populations of nucleic acids using a recombinational procedure termed "incremental truncation for the creation of hybrid enzymes" ("ITCHY") described in Ostermeier et al. (1999) "A combinatorial approach to hybrid enzymes independent of DNA homology" Nature Biotech 17:1205. This approach can be used to generate an initial library of variants which can optionally serve as a substrate for one or more in vitro or in vivo recombination methods. See, also, Ostermeier et al. (1999) "Combinatorial Protein Engineering by Incremental Truncation," Proc. Natl. Acad. Sci. USA, 96: 3562-67; and Ostermeier et al. (1999), "Incremental Truncation as a Strategy in the Engineering of Novel Biocatalysts," Biological and Medicinal Chemistry, 7: 2139-44.

Mutational methods which result in the alteration of individual nucleotides or groups of contiguous or non-contiguous nucleotides can be favorably employed to introduce nucleotide diversity into the nucleic acid sequences and/or gene fusion constructs of the present invention. Many mutagenesis methods are found in the above-cited references; additional details regarding mutagenesis methods can be found in following, which can also be applied to the present invention.

For example, error-prone PCR can be used to generate nucleic acid variants. Using this technique, PCR is performed under conditions where the copying fidelity of the DNA polymerase is low, such that a high rate of point mutations is obtained along the entire length of the PCR product. Examples of such techniques are found in the references above and, e.g., in Leung et al. (1989) Technique 1:11-15 and Caldwell et al. (1992) PCR Methods Applic. 2: 28-33. Similarly, assembly PCR can be used, in a process which involves the assembly of a PCR product from a mixture of small DNA fragments. A large number of different PCR reactions can occur in parallel in the same reaction mixture, with the products of one reaction priming the products of another reaction.

Oligonucleotide directed mutagenesis can be used to introduce site-specific mutations in a nucleic acid sequence of interest. Examples of such techniques are found in the references above and, e.g., in Reidhaar-Olson et al. (1988) Science 241:53-57. Similarly, cassette mutagenesis can be used in a process that replaces a small region of a double stranded DNA molecule with a synthetic oligonucleotide cassette that differs from the native sequence. The oligonucleotide can contain, e.g., completely and/or partially randomized native sequence(s).

Recursive ensemble mutagenesis is a process in which an algorithm for protein mutagenesis is used to produce diverse populations of phenotypically related mutants, members of which differ in amino acid sequence. This method uses a feedback mechanism to monitor successive rounds of combinatorial cassette mutagenesis. Examples of this approach are found in Arkin & Youvan (1992) Proc. Nat'l. Acad. Sci. USA 89:7811-7815.

Exponential ensemble mutagenesis can be used for generating combinatorial libraries with a high percentage of unique and functional mutants. Small groups of residues in a sequence of interest are randomized in parallel to identify, at each altered position, amino acids which lead to functional proteins. Examples of such procedures are found in Delegrave & Youvan (1993) Biotech. Res. 11:1548-1552.

In vivo mutagenesis can be used to generate random mutations in any cloned DNA of interest by propagating the DNA, e.g., in a strain of E. coli that carries mutations in one or more of the DNA repair pathways. These "mutator" strains have a higher random mutation rate than that of a wild-type parent. Propagating the DNA in one of these strains will eventually generate random mutations within the DNA. Such procedures are described in the references noted above.

Other procedures for introducing diversity into a genome, e.g. a bacterial, fungal, animal or plant genome can be used in conjunction with the above described and/or referenced methods. For example, in addition to the methods above, techniques have been proposed which produce nucleic acid multimers suitable for transformation into a variety of species (see, e.g., Schellenberger U.S. Pat. No. 5,756,316 and the references above). Transformation of a suitable host with such multimers, consisting of genes that are divergent with respect to one another, (e.g., derived from natural diversity or through application of site directed mutagenesis, error prone PCR, passage through mutagenic bacterial strains, and the like), provides a source of nucleic acid diversity for DNA diversification, e.g., by an in vivo recombination process as indicated above.

Alternatively, a multiplicity of monomeric polynucleotides sharing regions of partial sequence similarity can be transformed into a host species and recombined in vivo by the host cell. Subsequent rounds of cell division can be used to generate libraries, members of which, include a single, homogenous population, or pool of monomeric polynucleotides. Alternatively, the monomeric nucleic acids can be recovered by standard techniques, e.g., PCR and/or cloning, and recombined in any of the recombination formats, including recursive recombination formats, described above.

Methods for generating multispecies expression libraries have been described (in addition to the references noted above, see, e.g., Peterson et al. (1998) U.S. Pat. No. 5,783,431 "METHODS FOR GENERATING AND SCREENING NOVEL METABOLIC PATHWAYS;" and Thompson, et al. (1998) U.S. Pat. No. 5,824,485 METHODS FOR GENERATING AND SCREENING NOVEL METABOLIC PATHWAYS) and their use to identify protein activities of interest has been proposed (in addition to the references noted above, see, Short (1999) U.S. Pat. No. 5,958,672 "PROTEIN ACTIVITY SCREENING OF CLONES HAVING DNA FROM UNCULTIVATED MICROORGANISMS"). Multispecies expression libraries include, in general, libraries comprising cDNA or genomic sequences from a plurality of species or strains, operably linked to appropriate regulatory sequences, in an expression cassette. The cDNA and/or genomic sequences are optionally randomly ligated to further enhance diversity. The vector can be a shuttle vector suitable for transformation and expression in more than one species of host organism, e.g., bacterial species or eukaryotic cells. In some cases, the library is biased by preselecting sequences which encode a protein of interest, or which hybridize to a nucleic acid of interest. Any such libraries can be provided as substrates for any of the methods herein described.

The above described procedures have been largely directed to increasing nucleic acid and/or encoded protein diversity. However, in many cases, not all of the diversity is useful, e.g., functional, and contributes merely to increasing the background of variants that must be screened or selected to identify the few favorable variants. In some applications, it is desirable to preselect or prescreen libraries (e.g., an amplified library, a genomic library, a cDNA library, a normalized library, etc.) or other substrate nucleic acids prior to diversification, e.g., by recombination-based mutagenesis procedures, or to otherwise bias the substrates towards nucleic acids that encode functional products. For example, in the case of antibody engineering, it is possible to bias the diversity generating process toward antibodies with functional antigen binding sites by taking advantage of in vivo recombination events prior to manipulation by any of the described methods. For example, recombined CDRs derived from B cell cDNA libraries can be amplified and assembled into framework regions (e.g., Jirholt et al. (1998) "Exploiting sequence space: shuffling in vivo formed complementarity determining regions into a master framework" Gene 215: 471) prior to diversifying according to any of the methods described herein.

Libraries can be biased towards nucleic acids which encode proteins with desirable enzyme activities. For example, after identifying a clone from a library which exhibits a specified activity, the clone can be mutagenized using any known method for introducing DNA alterations. A library comprising the mutagenized homologues is then screened for a desired activity, which can be the same as or different from the initially specified activity. An example of such a procedure is proposed in Short (1999) U.S. Pat. No. 5,939,250 for "PRODUCTION OF ENZYMES HAVING DESIRED ACTIVITIES BY MUTAGENESIS." Desired activities can be identified by any method known in the art. For example, WO 99/10539 proposes that gene libraries can be screened by combining extracts from the gene library with components obtained from metabolically rich cells and identifying combinations which exhibit the desired activity. It has also been proposed (e.g., WO 98/58085) that clones with desired activities can be identified by inserting bioactive substrates into samples of the library, and detecting bioactive fluorescence corresponding to the product of a desired activity using a fluorescent analyzer, e.g., a flow cytometry device, a CCD, a fluorometer, or a spectrophotometer.

Libraries can also be biased towards nucleic acids which have specified characteristics, e.g., hybridization to a selected nucleic acid probe. For example, WO 99/10539 proposes that polynucleotides encoding a desired activity (e.g., an enzymatic activity, for example: a lipase, an esterase, a protease, a glycosidase, a glycosyl transferase, a phosphatase, a kinase, an oxygenase, a peroxidase, a hydrolase, a hydratase, a nitrilase, a transaminase, an amidase or an acylase) can be identified from among genomic DNA sequences. In particular, single stranded DNA molecules from a population of genomic DNA are hybridized to a ligand-conjugated probe. The genomic DNA can be derived from either a cultivated or uncultivated microorganism, or from an environmental sample. Alternatively, the genomic DNA can be derived from a multicellular organism, or a tissue derived therefrom. Second strand synthesis can be conducted directly from the hybridization probe used in the capture, with or without prior release from the capture medium or by a wide variety of other strategies known in the art. Alternatively, the isolated single-stranded genomic DNA population can be fragmented without further cloning and used directly in, e.g., a recombination-based approach, that employs a single-stranded template, as described above.

"Non-stochastic" methods of generating nucleic acids and polypeptides are described in Short "Non-Stochastic Generation of Genetic Vaccines and Enzymes" WO 00/46344. These methods, including proposed non-stochastic polynucleotide reassembly and site-saturation mutagenesis methods can be applied to the present invention as well. Random or semi-random mutagenesis using doped or degenerate oligonucleotides is also described in, e.g., Arkin and Youvan (1992) "Optimizing nucleotide mixtures to encode specific subsets of amino acids for semi-random mutagenesis" *Biotechnology* 10:297-300; Reidhaar-Olson et al. (1991) "Random mutagenesis of protein sequences using oligonucleotide cassettes" *Methods Enzymol.* 208:564-86; Lim and Sauer (1991) "The role of internal packing interactions in determining the structure and stability of a protein" *J. Mol. Biol.* 219:359-76; Breyer and Sauer (1989) "Mutational analysis of the fine specificity of binding of monoclonal antibody 51F to lambda repressor" *J. Biol. Chem.* 264:13355-60); "Walk-Through Mutagenesis" (Crea, R; U.S. Pat. Nos. 5,830,650 and 5,798,208, and EP Patent 0527809 B1.

It will be readily appreciated that any of the above described techniques suitable for enriching a library prior to diversification can also be used to screen the products, or libraries of products, produced by the diversity generating methods. Any of the above described methods can be practiced recursively or in combination to alter nucleic acids, e.g., GAT encoding polynucleotides.

Kits for mutagenesis, library construction and other diversity generation methods are also commercially available. For example, kits are available from, e.g., Stratagene (e.g., QuickChange™ site-directed mutagenesis kit; and Chameleon™ double-stranded, site-directed mutagenesis kit); Bio/Can Scientific, Bio-Rad (e.g., using the Kunkel method described above); Boehringer Mannheim Corp.; Clonetech Laboratories; DNA Technologies; Epicentre Technologies (e.g., 5 prime 3 prime kit); Genpak Inc.; Lemargo Inc.; Life Technologies (Gibco BRL); New England Biolabs; Pharmacia Biotech; Promega Corp.; Quantum Biotechnologies; Amersham International plc (e.g., using the Eckstein method above); and Anglian Biotechnology Ltd (e.g., using the Carter/Winter method above).

The above references provide many mutational formats, including recombination, recursive recombination, recursive mutation and combinations of recombination with other forms of mutagenesis, as well as many modifications of these formats. Regardless diversity generation format that is used, the nucleic acids of the present invention can be recombined (with each other, or with related (or even unrelated) sequences) to produce a diverse set of recombinant nucleic acids for use in the gene fusion constructs and modified gene fusion constructs of the present invention, including, e.g., sets of homologous nucleic acids, as well as corresponding polypeptides.

Many of the above-described methodologies for generating modified polynucleotides generate a large number of diverse variants of a parental sequence or sequences. In some preferred embodiments of the invention the modification technique (e.g., some form of shuffling) is used to generate a library of variants that is then screened for a modified polynucleotide or pool of modified polynucleotides encoding some desired functional attribute, e.g., improved GAT activity. Exemplary enzymatic activities that can be screened for include catalytic rates (conventionally characterized in terms of kinetic constants such as $k_{cat}$ and $K_M$), substrate specificity, and susceptibility to activation or inhibition by substrate, product or other molecules (e.g. inhibitors or activators).

One example of selection for a desired enzymatic activity entails growing host cells under conditions that inhibit the growth and/or survival of cells that do not sufficiently express an enzymatic activity of interest, e.g. the GAT activity. Using such a selection process can eliminate from consideration all modified polynucleotides except those encoding a desired enzymatic activity. For example, in some embodiments of the invention host cells are maintained under conditions that inhibit cell growth or survival in the absence of sufficient levels of GAT, e.g., a concentration of glyphosate that is lethal or inhibits the growth of a wild-type plant of the same variety that either lacks or does not express a GAT polynucleotide. Under these conditions, only a host cell harboring a modified nucleic acid that encodes enzymatic activity or activities able to catalyze production of sufficient levels of the product will survive and grow. Some embodiments of the invention employ multiple rounds of screening at increasing concentrations of glyphosate or a glyphosate analog.

In some embodiments of the invention, mass spectrometry is used to detect the acetylation of glyphosate, or a glyphosate analog or metabolite. The use of mass spectrometry is described in more detail in the Examples below.

For convenience and high throughput it will often be desirable to screen/select for desired modified nucleic acids in a microorganism, e.g., a bacteria such as *E. coli*. On the other hand, screening in plant cells or plants can in some cases be preferable where the ultimate aim is to generate a modified nucleic acid for expression in a plant system.

In some preferred embodiments of the invention throughput is increased by screening pools of host cells expressing different gene modified nucleic acids, either alone or as part of a gene fusion construct. Any pools showing significant activity can be deconvoluted to identify single clones expressing the desirable activity.

The skilled artisan will recognize that the relevant assay, screening or selection method will vary depending upon the desired host organism and other parameters known in the art. It is normally advantageous to employ an assay that can be practiced in a high-throughput format.

In high-throughput assays, it is possible to screen up to several thousand different variants in a single day. For example, each well of a microtiter plate can be used to run a separate assay, or, if concentration or incubation time effects are to be observed, every 5-10 wells can test a single variant.

In addition to fluidic approaches, it is possible, as mentioned above, simply to grow cells on media plates that select for the desired enzymatic or metabolic function. This approach offers a simple and high-throughput screening method.

A number of well known robotic systems have also been developed for solution phase chemistries useful in assay systems. These systems include automated workstations like the automated synthesis apparatus developed by Takeda Chemical Industries, LTD. (Osaka, Japan) and many robotic systems utilizing robotic arms (Zymate II, Zymark Corporation, Hopkinton, Mass.; and Orca, Hewlett-Packard, Palo Alto, Calif.) which mimic the manual synthetic operations performed by a scientist. Any of the above devices are suitable for application to the present invention. The nature and implementation of modifications to these devices (if any) so that they can operate as discussed herein with reference to the integrated system will be apparent to persons skilled in the relevant art.

High-throughput screening systems are commercially available (see, e.g., Zymark Corp., Hopkinton, Mass.; Air Technical Industries, Mentor, Ohio; Beckman Instruments, Inc. Fullerton, Calif.; Precision Systems, Inc., Natick, Mass., etc.). These systems typically automate entire procedures including all sample and reagent pipetting, liquid dispensing, timed incubations, and final readings of the microplate in detector(s) appropriate for the particular assay. These configurable systems provide high throughput and rapid start up as well as a high degree of flexibility and customization.

The manufacturers of such systems provide detailed protocols for the various high throughput devices. Thus, for example, Zymark Corp. provides technical bulletins describing screening systems for detecting the modulation of gene transcription, ligand binding, and the like. Microfluidic approaches to reagent manipulation have also been developed, e.g., by Caliper Technologies (Mountain View, Calif.).

Optical images viewed (and, optionally, recorded) by a camera or other recording device (e.g., a photodiode and data storage device) are optionally further processed in any of the embodiments herein, e.g., by digitizing the image and/or storing and analyzing the image on a computer. A variety of commercially available peripheral equipment and software is available for digitizing, storing and analyzing a digitized video or digitized optical image, e.g., using PC (Intel x86 or Pentium chip compatible DOS™, OS™ WINDOWS™, WINDOWS NT™ or WINDOWS 95™ based machines), MACINTOSH™, or UNIX based (e.g., SUN™ work station) computers.

One conventional system carries light from the assay device to a cooled charge-coupled device (CCD) camera, a common use in the art. A CCD camera includes an array of picture elements (pixels). The light from the specimen is imaged on the CCD. Particular pixels corresponding to regions of the specimen (e.g., individual hybridization sites on an array of biological polymers) are sampled to obtain light intensity readings for each position. Multiple pixels are processed in parallel to increase speed. The apparatus and methods of the invention are easily used for viewing any sample, e.g. by fluorescent or dark field microscopic techniques.

Other Polynucleotide Compositions

The invention also includes compositions comprising two or more polynucleotides of the invention (e.g., as substrates for recombination). The composition can comprise a library of recombinant nucleic acids, where the library contains at least 2, 3, 5, 10, 20, or 50 or more polynucleotides. The polynucleotides are optionally cloned into expression vectors, providing expression libraries.

The invention also includes compositions produced by digesting one or more polynucleotide of the invention with a restriction endonuclease, an RNAse, or a DNAse (e.g., as is performed in certain of the recombination formats noted above); and compositions produced by fragmenting or shearing one or more polynucleotide of the invention by mechanical means (e.g., sonication, vortexing, and the like), which can also be used to provide substrates for recombination in the methods above. Similarly, compositions comprising sets of oligonucleotides corresponding to more than one nucleic acid of the invention are useful as recombination substrates and are a feature of the invention. For convenience, these fragmented, sheared, or oligonucleotide synthesized mixtures are referred to as fragmented nucleic acid sets.

Also included in the invention are compositions produced by incubating one or more of the fragmented nucleic acid sets in the presence of ribonucleotide- or deoxyribonucelotide triphosphates and a nucleic acid polymerase. This resulting composition forms a recombination mixture for many of the recombination formats noted above. The nucleic acid polymerase may be an RNA polymerase, a DNA polymerase, or an RNA-directed DNA polymerase (e.g., a "reverse transcriptase"); the polymerase can be, e.g., a thermostable DNA polymerase (such as, VENT, TAQ, or the like).

Integrated Systems

The present invention provides computers, computer readable media and integrated systems comprising character strings corresponding to the sequence information herein for the polypeptides and nucleic acids herein, including, e.g., those sequences listed herein and the various silent substitutions and conservative substitutions thereof.

For example, various methods and genetic algorithms (GAs) known in the art can be used to detect homology or similarity between different character strings, or can be used to perform other desirable functions such as to control output files, provide the basis for making presentations of information including the sequences and the like. Examples include BLAST, discussed supra.

Thus, different types of homology and similarity of various stringency and length can be detected and recognized in the integrated systems described herein. For example, many homology determination methods have been designed for comparative analysis of sequences of biopolymers, for spell-checking in word processing, and for data retrieval from various databases. With an understanding of double-helix pair-wise complement interactions among 4 principal nucleobases in natural polynucleotides, models that simulate annealing of complementary homologous polynucleotide strings can also be used as a foundation of sequence alignment or other operations typically performed on the character strings corresponding to the sequences herein (e.g., word-processing manipulations, construction of figures comprising sequence or subsequence character strings, output tables, etc.). An example of a software package with GAs for calculating sequence similarity is BLAST, which can be adapted to the present invention by inputting character strings corresponding to the sequences herein.

Similarly, standard desktop applications such as word processing software (e.g., Microsoft Word™ or Corel WordPerfect™) and database software (e.g., spreadsheet software such as Microsoft Excel™, Corel Quattro Pro™, or database programs such as Microsoft Access™ or Paradox™) can be adapted to the present invention by inputting a character string corresponding to the GAT homologues of the invention (either nucleic acids or proteins, or both). For example, the integrated systems can include the foregoing software having the appropriate character string information, e.g., used in conjunction with a user interface (e.g., a GUI in a standard operating system such as a Windows, Macintosh or LINUX system) to manipulate strings of characters. As noted, specialized alignment programs such as BLAST can also be incorporated into the systems of the invention for alignment of nucleic acids or proteins (or corresponding character strings).

Integrated systems for analysis in the present invention typically include a digital computer with GA software for aligning sequences, as well as data sets entered into the software system comprising any of the sequences herein. The computer can be, e.g., a PC (Intel x86 or Pentium chip compatible DOS™, OS2™ WINDOWS™ WINDOWS NT™, WINDOWS95™, WINDOWS98™ LINUX based machine, a MACINTOSH™, Power PC, or a UNIX based (e.g., SUN™ work station) machine) or other commercially common computer which is known to one of skill. Software for aligning or otherwise manipulating sequences is available, or can easily be constructed by one of skill using a standard programming language such as Visualbasic, Fortran, Basic, Java, or the like.

Any controller or computer optionally includes a monitor which is often a cathode ray tube ("CRT") display, a flat panel display (e.g., active matrix liquid crystal display, liquid crystal display), or others. Computer circuitry is often placed in a box which includes numerous integrated circuit chips, such as a microprocessor, memory, interface circuits, and others. The box also optionally includes a hard disk drive, a floppy disk drive, a high capacity removable drive such as a writeable CD-ROM, and other common peripheral elements. Inputting devices such as a keyboard or mouse optionally provide for input from a user and for user selection of sequences to be compared or otherwise manipulated in the relevant computer system.

The computer typically includes appropriate software for receiving user instructions, either in the form of user input into set parameter fields, e.g., in a GUI, or in the form of preprogrammed instructions, e.g., preprogrammed for a variety of different specific operations. The software then converts these instructions to appropriate language for instructing the operation of the fluid direction and transport controller to carry out the desired operation.

The software can also include output elements for controlling nucleic acid synthesis (e.g., based upon a sequence or an alignment of a sequences herein) or other operations which occur downstream from an alignment or other operation performed using a character string corresponding to a sequence herein. Nucleic acid synthesis equipment can, accordingly, be a component in one or more integrated systems herein.

In an additional aspect, the present invention provides kits embodying the methods, composition, systems and apparatus herein. Kits of the invention optionally comprise one or more of the following: (1) an apparatus, system, system component or apparatus component as described herein; (2) instructions for practicing the methods described herein, and/or for operating the apparatus or apparatus components herein and/or for using the compositions herein; (3) one or more GAT compositions or components; (4) a container for holding components or compositions, and, (5) packaging materials.

In a further aspect, the present invention provides for the use of any apparatus, apparatus component, composition or kit herein, for the practice of any method or assay herein, and/or for the use of any apparatus or kit to practice any assay or method herein.

Host Cells and Organisms

The host cell can be eukaryotic, for example, a eukaryotic cell, a plant cell, an animal cell, a protoplast, or a tissue culture cell. The host cell optionally comprises a plurality of cells, for example, an organism. Alternatively, the host cell can be prokaryotic including, but not limited to, bacteria (i.e., gram positive bacteria, purple bacteria, green sulfur bacteria, green non-sulfur bacteria, cyanobacteria, spirochetes, thermatogales, flavobacteria, and bacteroides) and archaebacteria (i.e., Korarchaeota, Thermoproteus, Pyrodictium, Thermococcales, Methanogens, Archaeoglobus, and extreme Halophiles).

Transgenic plants, or plant cells, incorporating the GAT nucleic acids, and/or expressing the GAT polypeptides of the invention are a feature of the invention. The transformation of plant cells and protoplasts can be carried out in essentially any of the various ways known to those skilled in the art of plant molecular biology, including, but not limited to, the methods described herein. See, in general, *Methods in Enzymology*, Vol. 153 (*Recombinant DNA Part D*) Wu and Grossman (eds.) 1987, Academic Press; and Weising et al., *Ann. Rev. Genet.* 22: 421-477 (1988), incorporated herein by reference. For example, the DNA construct may be introduced directly into the genomic DNA of the plant cell using techniques such as electroporation, PEG-mediated transfection, particle bombardment, silicon fiber delivery, or microinjection of plant cell protoplasts or embryogenic callus. See, e.g., Tomes, et al. (1995) "Direct DNA Transfer into Intact Plant Cells Via Microprojectile Bombardment," in *Plant Cell, Tissue and Organ Culture, Fundamental Methods*, eds. Gamborg and Phillips (Springer-Verlag, Berlin), pp. 197-213. Further methods for transforming various host cells are disclosed in Klein et al. (1992) "Transformation of microbes, plants and animals by particle bombardment" *Bio/Technol.* 10 (3): 286-291.

The introduction of DNA constructs using polyethylene glycol precipitation is described in Paszkowski et al. (1984) *EMBO J.* 3:2717-2722. Electroporation techniques are described in Fromm et al. (1985) *Proc. Natl. Acad. Sci.* 82:5824. Ballistic transformation techniques are described in Klein et al. (1987) *Nature* 327: 70-73.

Alternatively, the DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. See, U.S. Pat. No. 5,591,616.

*Agrobacterium tumefaciens*-meditated transformation techniques are well described in the scientific literature. See, for example Horsch et al. (1984) *Science* 233: 496-498, and Fraley et al. (1983) *Proc. Natl. Acad. Sci.* 80:4803. For instance, *Agrobacterium* transformation of maize is described in U.S. Pat. Nos. 5,550,318 and 5,981,840.

Other methods of transformation include (1) *Agrobacterium rhizogenes*-mediated transformation (see, e.g., Lichtenstein and Fuller In: Genetic Engineering, Vol. 6, P W J Rigby, ed., London, Academic Press, 1987; Lichtenstein, C. P., and Draper, J. In: DNA Cloning, Vol. II, D. M. Glover, Ed., Oxford, IRI Press, 1985; WO 88/02405 describes the use of *A. rhizogenes* strain A4 and its R1 plasmid along with *A. tumefaciens* vectors pARC8 or pARC16); (2) liposome-mediated DNA uptake (see, e.g., Freeman et al. (1984) *Plant Cell Physiol.* 25:1353; (3) the vortexing method (see, e.g., Kindle (1990) *Proc. Natl. Acad. Sci. USA* 87:1228.

DNA can also be introduced into plants by direct DNA transfer into pollen as described by Zhou et al. (1983) *Methods in Enzymology* 101:433; D. Hess (1987) *Intern Rev. Cytol.* 107:367; and Luo et al. (1988) *Plant Mol. Biol. Reporter* 6:165. Expression of polypeptide coding nucleic acids can be obtained by injection of the DNA into reproductive organs of a plant as described by Pena et al. (1987) *Nature* 325:274. DNA can also be injected directly into the cells of immature embryos and the rehydration of desiccated embryos as described by Neuhaus et al. (1987) *Theor. Appl. Genet.* 75: 30; and Benbrook et al. (1986) in Proceedings Bio Expo 1986, Butterworth, Stoneham, Mass., pp. 27-54.

Animal and lower eukaryotic (e.g., yeast) host cells are competent or rendered competent for transfection by various means. There are several well-known methods of introducing DNA into animal cells. These methods include: calcium phosphate precipitation; fusion of the recipient cells with bacterial protoplasts containing the DNA; treatment of the recipient cells with liposomes containing the DNA; DEAE dextran; electroporation; biolistics; and micro-injection of the DNA directly into the cells. The transfected cells are cultured by means well known in the art. See, Kuchler, R. J. (1977) *Biochemical Methods in Cell Culture and Virology* (Dowden, Hutchinson and Ross, Inc.). As used herein, the term "transformation" means alteration of the genotype of a host plant by the introduction of a nucleic acid sequence, e.g., a "heterologous" or "foreign" nucleic acid sequence. The heterologous nucleic acid sequence need not necessarily originate from a different source but it will, at some point, have been external to the cell into which it is introduced.

In addition to Berger, Ausubel and Sambrook, useful general references for plant cell cloning, culture and regeneration include Jones, ed. (1995) *Plant Gene Transfer and Expression Protocols-Methods in Molecular Biology*, volume 49 (Humana Press, Towata, NJ); Payne et al. (1992) *Plant Cell and Tissue Culture in Liquid Systems* (John Wiley & Sons, Inc. New York, N.Y.) ("Payne"); and Gamborg and Phillips, eds. (1995) *Plant Cell, Tissue and Organ Culture; Fundamental Methods/Springer Lab Manual*, (Springer-Verlag, Berlin) ("Gamborg"). A variety of cell culture media are described in Atlas and Parks, eds. *The Handbook of Microbiological Media* (CRC Press, Boca Raton, Fla.) ("Atlas"). Additional information for plant cell culture is found in available commercial literature such as the *Life Science Research Cell Culture Catalogue* (1998) from Sigma-Aldrich, Inc. (St Louis, Mo.) (Sigma-LSRCCC) and, e.g., the *Plant Culture Catalogue* and supplement (1997) also from Sigma-Aldrich, Inc. (St Louis, Mo.) (Sigma-PCCS). Additional details regarding plant cell culture are found in Croy, ed. (1993) *Plant Molecular Biology* (Bios Scientific Publishers, Oxford, UK).

In an embodiment of this invention, recombinant vectors including one or more GAT polynucleotides, suitable for the transformation of plant cells are prepared. A DNA sequence encoding for the desired GAT polypeptide, e.g., selected from among SEQ ID NO: 516, 517, 518, 519, 520, 521, 522, 523, 524, 525, 526, 527, 528, 529, 530, 531, 532, 533, 534, 535, 536, 531, 538, 539, 540, 541, 542, 543, 544, 545, 546, 547, 548, 549, 550, 551, 552, 553, 554, 555, 556, 557, 558, 559, 560, 561, 562, 563, 564, 565, 566, 567, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 768, 770, 772, 774, 776, 778, 780, 782, 784, 786, 788, 790, 792, 794, 796, 798, 800, 802, 804, 806, 808, 810, 812, 814, 816, 818, 820, 822, 824, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 933, 934, 935, 936, 937, 938, 939, 940, 941, 942, 943, 944, 945, 947, 949, 951, and 952, is conveniently used to construct a recombinant expression cassette which can be introduced into the desired plant. In the context of the present invention, an expression cassette will typically comprise a selected GAT polynucleotide operably linked to a promoter sequence and other transcriptional and translational initiation regulatory sequences which are sufficient to direct the transcription of the GAT sequence in the intended tissues (e.g., entire plant, leaves, roots, etc.) of the transformed plant.

A number of promoters can be used in the practice of the present invention. The promoters can be selected based on the desired outcome. That is, the nucleic acids can be combined with constitutive, tissue-preferred, or other promoters for expression in plants.

Constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) *Nature* 313: 810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142; and 6,177,611.

Chemical-regulated promoters can be used to modulate the expression of a gene in a plant through the application of an exogenous chemical regulator. Depending upon the objective, the promoter may be a chemical-inducible promoter, where application of the chemical induces gene expression, or a chemical-repressible promoter, where application of the chemical represses gene expression. Chemical-inducible promoters are known in the art and include, but are not limited to, the maize In2-2 promoter, which is activated by benzene sulfonamide herbicide safeners; the maize GST promoter, which is activated by hydrophobic electrophilic compounds that are used as pre-emergent herbicides; and the tobacco PR-1a promoter, which is activated by salicylic acid. Other chemical-regulated promoters of interest include steroid-responsive promoters. See, for example, the glucocorticoid-inducible promoter in Schena et al. (1991) *Proc. Natl. Acad. Sci. USA* 88:10421-10425 and McNellis et al. (1998) *Plant J.* 14(2):247-257 and the tetracycline-inducible and tetracycline-repressible promoters for example, Gatz et al. (1991)

*Mol. Gen. Genet.* 227:229-237, and U.S. Pat. Nos. 5,814,618 and 5,789,156, herein incorporated by reference.

Tissue-preferred promoters can also be utilized to target GAT expression within a particular plant tissue. Tissue-preferred promoters include those disclosed in Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2): 157-168; Rinehart et al. (1996) *Plant Physiol.* 112(3): 1331-1341; Van Camp et al. (1996) *Plant Physiol.* 112(2): 525-535; Canevascini et al. (1996) *Plant Physiol.* 112(2): 513-524; Yamamoto et al. (1994) *Plant Cell Physiol.* 35(5): 773-778; Lam (1994) *Results Probl. Cell Differ.* 20:181-196; Orozco et al. (1993) *Plant Mol. Biol.* 23(6):1129-1138; Matsuoka et al. (1993) *Proc Natl. Acad. Sci. USA* 90(20):9586-9590; and Guevara-Garcia et al. (1993) *Plant J.* 4(3):495-505. Such promoters can be modified, if necessary, for weak expression.

Leaf-specific promoters are known in the art. See, for example, Yamamoto et al. (1997) *Plant J* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20):9586-9590.

Root-preferred promoters are known and can be selected from the many available from the literature or isolated de novo from various compatible species. See, for example, Hire et al. (1992) *Plant Mol. Biol.* 20(2):207-218 (soybean root-specific glutamine synthetase gene); Keller et al. (1991) *Plant Cell* 3(10):1051-1061 (root-specific control element in the GRP 1.8 gene of French bean); Sanger et al. (1990) *Plant Mol. Biol.* 14(3):433-443 (root-specific promoter of the mannopine synthase (MAS) gene of *Agrobacterium tumefaciens*); and Miao et al. (1991) *Plant Cell* 3(1): 11-22 (full-length cDNA clone encoding cytosolic glutamine synthetase (GS), which is expressed in roots and root nodules of soybean). See also Bogusz et al. (1990) *Plant Cell* 2(7):633-641, which discloses two root-specific promoters isolated from hemoglobin genes from the nitrogen-fixing nonlegume *Parasponia andersonii* and the related non-nitrogen-fixing nonlegume *Trema tomentosa*. The promoters of these genes were linked to a β-glucuronidase reporter gene and introduced into both the nonlegume *Nicotiana tabacum* and the legume *Lotus corniculatus*, and in both instances root-specific promoter activity was preserved. Leach et al. (1991) describe their analysis of the promoters of the highly expressed rolC and rolD root-inducing genes of *Agrobacterium rhizogenes* (see *Plant Science* (Limerick) 79(1):69-76). They concluded that enhancer and tissue-preferred DNA determinants are dissociated in those promoters. Teeri et al. (1989) *EMBO J.* 8(2): 343-350 used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, which is an especially desirable combination of characteristics for use with an insecticidal or larvicidal gene. The TR1' gene, fused to nptII (neomycin phosphotransferase II), showed similar characteristics. Additional root-preferred promoters include the VfENOD-GRP3 gene promoter (Kuster et al. (1995) *Plant Mol. Biol.* 29(4):759-772); the ZRP2 promoter (U.S. Pat. No. 5,633,636); the IFS1 promoter (U.S. patent application Ser. No. 10/104,706) and the rolB promoter (Capana et al. (1994) *Plant Mol. Biol.* 25(4):681-691). See also U.S. Pat. Nos. 5,837,876; 5,750,386; 5,459,252; 5,401,836; 5,110,732; and 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108, herein incorporated by reference. Such seed-preferred promoters include, but are not limited to, Cim1 (cytokinin-induced message); cZ19B1 (maize 19 kDa zein); milps (myo-inositol-1-phosphate synthase); and celA (cellulose synthase) (see U.S. Pat. No. 6,225,529, herein incorporated by reference). Gamma-zein is an endosperm-specific promoter. Glob-1 is an embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also WO 00/12733, which discloses seed-preferred promoters from end1 and end2 genes; herein incorporated by reference.

In particular, a strongly or weakly constitutive plant promoter that directs expression of a GAT nucleic acid in all tissues of a plant can be favorably employed. Such promoters are active under most environmental conditions and states of development or cell differentiation. In addition to the promoters mentioned above examples of constitutive promoters include the 1'- or 2'-promoter of *Agrobacterium tumefaciens*, and other transcription initiation regions from various plant genes known to those of skill. Where over expression of a GAT polypeptide of the invention is detrimental to the plant, one of skill will recognize that weak constitutive promoters can be used for low-levels of expression. Generally, by "weak promoter" a promoter that drives expression of a coding sequence at a low level is intended. By "low level" levels from about 1/1000 transcripts to about 1/100,000 transcripts, to about as low as 1/500,000 transcripts per cell are intended. Alternatively, it is recognized that weak promoters also include promoters that are expressed in only a few cells and not in others to give a total low level of expression. Where a promoter is expressed at unacceptably high levels, portions of the promoter sequence can be deleted or modified to decrease expression levels. In those cases where high levels of expression is not harmful to the plant, a strong promoter, e.g., a t-RNA, or other pol III promoter, or a strong pol II promoter, (e.g., the cauliflower mosaic virus promoter, CaMV, 35S promoter) can be used.

Alternatively, a plant promoter can be under environmental control. Such promoters are referred to as "inducible" promoters. Examples of environmental conditions that may alter transcription by inducible promoters include pathogen attack, anaerobic conditions, or the presence of light. In some cases, it is desirable to use promoters that are "tissue-specific" and/or are under developmental control such that the GAT polynucleotide is expressed only in certain tissues or stages of development, e.g., leaves, roots, shoots, etc. Endogenous promoters of genes related to herbicide tolerance and related phenotypes are particularly useful for driving expression of GAT nucleic acids, e.g., P450 monooxygenases, glutathione-S-transferases, homoglutathione-S-transferases, glyphosate oxidases and 5-enolpyruvylshikimate-2-phosphate synthases.

Tissue specific promoters can also be used to direct expression of heterologous structural genes, including the GAT polynucleotides described herein. Thus the promoters can be used in recombinant expression cassettes to drive expression of any gene whose expression is desirable in the transgenic plants of the invention, e.g., GAT and/or other genes conferring herbicide resistance or tolerance, genes which influence other useful characteristics, e.g., heterosis. Similarly, enhancer elements, e.g., derived from the 5' regulatory sequences or intron of a heterologous gene, can also be used to improve expression of a heterologous structural gene, such as a GAT polynucleotide.

In general, the particular promoter used in the expression cassette in plants depends on the intended application. Any of a number of promoters which direct transcription in plant cells can be suitable. The promoter can be either constitutive or inducible. In addition to the promoters noted above, promoters of bacterial origin which operate in plants include the octopine synthase promoter, the nopaline synthase promoter and other promoters derived from T1 plasmids. See, Herrera-Estrella et al. (1983) *Nature* 303:209. Viral promoters include the 35S and 19S RNA promoters of CaMV. See, Odell et al. (1985) *Nature* 313:810. Other plant promoters include the ribulose-1,3-bisphosphate carboxylase small subunit promoter and the phaseolin promoter. The promoter sequence from the E8 gene (see, Deikman and Fischer (1988) *EMBO J.* 7:3315) and other genes are also favorably used. Promoters specific for monocotyledonous species are also considered (McElroy and Brettell (1994) "Foreign gene expression in transgenic cereals" *Trends Biotech.* 12:62-68.) Alternatively, novel promoters with useful characteristics can be identified from any viral, bacterial, or plant source by methods, including sequence analysis, enhancer or promoter trapping, and the like, known in the art.

In preparing expression vectors of the invention, sequences other than the promoter and the GAT encoding gene are also favorably used. If proper polypeptide expression is desired, a polyadenylation region can be derived from the natural gene, from a variety of other plant genes, or from T-DNA. Signal/localization peptides, which, e.g., facilitate translocation of the expressed polypeptide to internal organelles (e.g., chloroplasts) or extracellular secretion, can also be employed.

The vector comprising the GAT polynucleotide also can include a marker gene which confers a selectable phenotype on plant cells. For example, the marker may encode biocide tolerance, particularly antibiotic tolerance, such as tolerance to kanamycin, G418, bleomycin, hygromycin, or herbicide tolerance, such as tolerance to chlorosulfuron, or phophinothricin. Reporter genes, which are used to monitor gene expression and protein localization via visualizable reaction products (e.g., beta-glucuronidase, beta-galactosidase, and chloramphenicol acetyltransferase) or by direct visualization of the gene product itself (e.g., green fluorescent protein, GFP; Sheen et al. (1995) *The Plant Journal* 8:777) can be used for, e.g., monitoring transient gene expression in plant cells. Transient expression systems can be employed in plant cells, for example, in screening plant cell cultures for herbicide tolerance activities.

Plant Transformation

Protoplasts

Numerous protocols for establishment of transformable protoplasts from a variety of plant types and subsequent transformation of the cultured protoplasts are available in the art and are incorporated herein by reference. For examples, see, Hashimoto et al. (1990) *Plant Physiol.* 93: 857; Fowke and Constabel, eds. (1994) *Plant Protoplasts*; Saunders et al. (1993) *Applications of Plant In vitro Technology Symposium*, UPM 16-18; and Lyznik et al. (1991) *BioTechniques* 10:295, each of which is incorporated herein by reference.

Chloroplasts

Chloroplasts are a site of action of some herbicide tolerance activities, and, in some instances, the GAT polynucleotide is fused to a chloroplast transit sequence peptide to facilitate translocation of the gene products into the chloroplasts. In these cases, it can be advantageous to transform the GAT polynucleotide into the chloroplasts of the plant host cells. Numerous methods are available in the art to accomplish chloroplast transformation and expression (e.g., Daniell et al. (1998) *Nature Biotech.* 16:346; O'Neill et al. (1993) *The Plant Journal* 3:729; and Maliga (1993) *TIBTECH* 11:1). The expression construct comprises a transcriptional regulatory sequence functional in plants operably linked to a polynucleotide encoding the GAT polypeptide. Expression cassettes that are designed to function in chloroplasts (such as an expression cassette including a GAT polynucleotide) include the sequences necessary to ensure expression in chloroplasts. Typically, the coding sequence is flanked by two regions of homology to the chloroplastid genome to effect a homologous recombination with the chloroplast genome; often a selectable marker gene is also present within the flanking plastid DNA sequences to facilitate selection of genetically stable transformed chloroplasts in the resultant transplastonic plant cells (see, e.g., Maliga (1993) and Daniell (1998) supra, and references cited therein).

General Transformation Methods

DNA constructs of the invention can be introduced into the genome of the desired plant host by a variety of conventional techniques. Techniques for transforming a wide variety of higher plant species are well known and described in the technical and scientific literature. See, e.g., Payne, Gamborg, Croy, Jones, etc. all supra, as well as, e.g., Weising et al. (1988) *Ann. Rev. Genet.* 22:421 and U.S. Pat. Nos. 5,889,191, 5,889,190, 5,866,785, 5,589,367 and 5,316,931, herein incorporated by reference.

A variety of other transformation protocols are contemplated in the present invention. Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway et al. (1986) *Biotechniques* 4:320-334), electroporation (Riggs et al. (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski et al. (1984) *EMBO J.* 3:2717-2722), and ballistic particle acceleration (see, for example, U.S. Pat. Nos. 4,945,050; U.S. Pat. Nos. 5,879,918; 5,886,244; 5,932,782; Tomes et al. (1995) "Direct DNA Transfer into Intact Plant Cells via Microprojectile Bombardment," in *Plant Cell, Tissue, and Organ Culture: Fundamental Methods*, Eds., Gamborg and Phillips (Springer-Verlag, Berlin); McCabe et al. (1988) *Biotechnology* 6:923-926); and Lec1 transformation (WO 00/28058). See also, Weissinger et al. (1988) *Ann. Rev. Genet.* 22:421-477; Sanford et al. (1987) *Particulate Science and Technology* 5:27-37 (onion); Christou et al. (1988) *Plant Physiol.* 87:671-674 (soybean); McCabe et al. (1988) *Bio/Technology* 6:923-926 (soybean); Finer and McMullen (1991) *In vitro Cell Dev. Biol.* 27P:175-182 (soybean); Singh et al. (1998) *Theor. Appl. Genet.* 96:319-324 (soybean); Datta et al. (1990) *Biotechnology* 8:736-740 (rice); Klein et al. (1988) *Proc. Natl. Acad. Sci. USA* 85:4305-4309 (maize); Klein et al. (1988) *Biotechnology* 6:559-563 (maize); U.S. Pat. Nos. 5,240,855; 5,322,783 and 5,324,646; Klein et al. (1988) *Plant Physiol.* 91:440-444 (maize); Fromm et al. (1990) *Biotechnology* 8:833-839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae);

De Wet et al. (1985) in *The Experimental Manipulation of Ovule Tissues*, Eds., Chapman et al. (Longman, New York), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference.

For example, DNAs can be introduced directly into the genomic DNA of a plant cell using techniques such as electroporation and microinjection of plant cell protoplasts, or the DNA constructs can be introduced directly to plant tissue using ballistic methods, such as DNA particle bombardment. Alternatively, the DNA constructs can be combined with suitable T-DNA flanking regions and introduced into a conventional *Agrobacterium tumefaciens* host vector. The virulence functions of the *Agrobacterium* host will direct the insertion of the construct and adjacent marker into the plant cell DNA when the plant cell is infected by the bacteria.

Microinjection techniques are known in the art and well described in the scientific and patent literature. The introduction of DNA constructs using polyethylene glycol precipitation is described in Paszkowski et al (1984) *EMBO J.* 3:2717. Electroporation techniques are described in Fromm et al. (1985) *Proc Nat'l Acad Sci USA* 82:5824. Ballistic transformation techniques are described in Klein et al. (1987) *Nature* 327:70; and Weeks et al. *Plant Physiol* 102:1077.

In some embodiments, *Agrobacterium* mediated transformation techniques are used to transfer the GAT sequences of the invention to transgenic plants. *Agrobacterium*-mediated transformation is widely used for the transformation of dicots, however, certain monocots can also be transformed by *Agrobacterium*. For example, *Agrobacterium* transformation of rice is described by Hiei et al. (1994) *Plant J.* 6:271; U.S. Pat. No. 5,187,073; U.S. Pat. No. 5,591,616; Li et al. (1991) *Science in China* 34:54; and Raineri et al. (1990) *Bio/Technology* 8: 33. Transformed maize, barley, triticale and asparagus by *Agrobacterium* mediated transformation have also been described (Xu et al. (1990) *Chinese J Bot* 2:81).

*Agrobacterium* mediated transformation techniques take advantage of the ability of the tumor-inducing (Ti) plasmid of *A. tumefaciens* to integrate into a plant cell genome, to co-transfer a nucleic acid of interest into a plant cell. Typically, an expression vector is produced wherein the nucleic acid of interest, such as a GAT polynucleotide of the invention, is ligated into an autonomously replicating plasmid which also contains T-DNA sequences. T-DNA sequences typically flank the expression cassette nucleic acid of interest and comprise the integration sequences of the plasmid. In addition to the expression cassette, T-DNA also typically includes a marker sequence, e.g., antibiotic resistance genes. The plasmid with the T-DNA and the expression cassette are then transfected into *Agrobacterium* cells. Typically, for effective transformation of plant cells, the *A. tumefaciens* bacterium also possesses the necessary vir regions on a plasmid, or integrated into its chromosome. For a discussion of *Agrobacterium* mediated transformation, see, Firoozabady and Kuehnle, (1995) in *Plant Cell Tissue and Organ Culture Fundamental Methods*, eds. Gamborg and Phillips.

In certain embodiments the polynucleotides of the present invention can be stacked with any combination of polynucleotide sequences of interest in order to create plants with a desired phenotype. For example, the polynucleotides of the present invention may be stacked with any other polynucleotides encoding polypeptides having pesticidal and/or insecticidal activity, such as *Bacillus thuringiensis* toxic proteins (described in U.S. Pat. Nos. 5,366,892; 5,747,450; 5,737,514; 5,723,756; 5,593,881; and Geiser et al. (1986) Gene 48:109), lectins (Van Damme et al. (1994) *Plant Mol. Biol.* 24:825, pentin (described in U.S. Pat. No. 5,981,722), and the like. The combinations generated can also include multiple copies of any one of the polynucleotides of interest. The polynucleotides of the present invention can also be stacked with any other gene or combination of genes to produce plants with a variety of desired trait combinations including, but not limited to, traits desirable for animal feed such as high oil genes (e.g., U.S. Pat. No. 6,232,529); balanced amino acids (e.g., hordothionins (U.S. Pat. Nos. 5,990,389; 5,885,801; 5,885,802; and 5,703,409); barley high lysine (Williamson et al. (1987) *Eur. J. Biochem.* 165:99-106; and WO 98/20122) and high methionine proteins (Pedersen et al. (1986) *J. Biol. Chem.* 261:6279; Kirihara et al. (1988) *Gene* 71:359; and Musumura et al. (1989) *Plant Mol. Biol.* 12:123)); increased digestibility (e.g., modified storage proteins (U.S. application Ser. No. 10/053,410, filed Nov. 7, 2001); and thioredoxins (U.S. application Ser. No. 10/005,429, filed Dec. 3, 2001)); the disclosures of which are herein incorporated by reference.

The polynucleotides of the present invention can also be stacked with traits desirable for disease or herbicide resistance (e.g., fumonisin detoxification genes (U.S. Pat. No. 5,792,931); avirulence and disease resistance genes (Jones et al. (1994) *Science* 266:789; Martin et al. (1993) *Science* 262: 1432; Mindrinos et al. (1994) *Cell* 78:1089); acetolactate synthase (ALS) mutants that lead to herbicide resistance such as the S4 and/or Hra mutations; inhibitors of glutamine synthase such as phosphinothricin or basta (e.g., bar gene); and glyphosate resistance (EPSPS gene)); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) *J. Bacteriol.* 170:5837-5847) facilitate expression of polyhydroxyalkanoates (PHAs)); the disclosures of which are herein incorporated by reference. One could also combine the polynucleotides of the present invention with polynucleotides providing agronomic traits such as male sterility (e.g., see U.S. Pat. No. 5,583,210), stalk strength, flowering time, or transformation technology traits such as cell cycle regulation or gene targeting (e.g., WO 99/61619, WO 00/17364, and WO 99/25821); the disclosures of which are herein incorporated by reference.

These stacked combinations can be created by any method including, but not limited to, cross-breeding plants by any conventional or TopCross methodology, or genetic transformation. If the traits are stacked by genetically transforming the plants, the polynucleotide sequences of interest can be combined at any time and in any order. For example, a transgenic plant comprising one or more desired traits can be used as the target to introduce further traits by subsequent transformation. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO99/25821, WO99/25854, WO99/25840, WO99/25855, and WO99/25853, all of which are herein incorporated by reference.

Regeneration of Transgenic Plants

Transformed plant cells which are derived by plant transformation techniques, including those discussed above, can be cultured to regenerate a whole plant which possesses the transformed genotype (i.e., a GAT polynucleotide), and thus the desired phenotype, such as acquired resistance (i.e., tolerance) to glyphosate or a glyphosate analog. Such regeneration techniques rely on manipulation of certain phytohormones in a tissue culture growth medium, typically relying on a biocide and/or herbicide marker which has been introduced together with the desired nucleotide sequences. For transformation and regeneration of maize see, Gordon-Kamm et al., *The Plant Cell*, 2:603-618 (1990). Alternatively, selection for glyphosate resistance conferred by the GAT polynucleotide of the invention can be performed. Plant regeneration from cultured protoplasts is described in Evans et al. (1983) *Protoplasts Isolation and Culture. Handbook of Plant Cell Culture*, pp 124-176, Macmillan Publishing Company, New York; and Binding (1985) *Regeneration of Plants, Plant Protoplasts* pp 21-73, CRC Press, Boca Raton. Regeneration can also be obtained from plant callus, explants, organs, or parts thereof. Such regeneration techniques are described generally in Klee et al. (1987) *Ann Rev of Plant Phys* 38:467. See also, e.g., Payne and Gamborg.

Transformed plant cells, calli or explant can be cultured on regeneration medium in the dark for several weeks, generally about 1 to 3 weeks to allow the somatic embryos to mature. Preferred regeneration media include media containing MS salts. The plant cells, calli or explant are then typically cultured on rooting medium in a light/dark cycle until shoots and roots develop. Methods for plant regeneration are known in the art and preferred methods are provided by Kamo et al., (*Bot. Gaz.* 146(3):324-334, 1985); West et al., (*The Plant Cell* 5:1361-1369, 1993); and Duncan et al. (*Planta* 165:322-332, 1985).

Small plantlets can then be transferred to tubes containing rooting medium and allowed to grow and develop more roots for approximately another week. The plants can then be transplanted to soil mixture in pots in the greenhouse.

The regeneration of plants containing the foreign gene introduced by *Agrobacterium* can be achieved as described by Horsch et al., *Science*, 227:1229-1231 (1985) and Fraley et al., *Proc. Natl. Acad. Sci. U.S.A.*, 80:4803 (1983). This procedure typically produces shoots within two to four weeks and these transformant shoots are then transferred to an appropriate root-inducing medium containing the selective agent and an antibiotic to prevent bacterial growth. Transgenic plants of the present invention may be fertile or sterile.

Regeneration can also be obtained from plant callus, explants, organs, or parts thereof. Such regeneration techniques are described generally in Klee et al., *Ann. Rev. of Plant Phys.* 38:467-486 (1987). The regeneration of plants from either single plant protoplasts or various explants is well known in the art. See, for example, Methods for Plant Molecular Biology, A. Weissbach and H. Weissbach, eds., Academic Press, Inc., San Diego, Calif. (1988). For maize cell culture and regeneration see generally, *The Maize Handbook*, Freeling and Walbot, eds., Springer, New York (1994); *Corn and Corn Improvement*, $3^{rd}$ Ed., Sprague and Dudley eds., American Society of Agronomy, Madison, Wis. (1988).

After transformation with *Agrobacterium*, the explants typically are transferred to selection medium. One of skill will realize that the selection medium depends on the selectable marker that was co-transfected into the explants. After a suitable length of time, transformants will begin to form shoots. After the shoots are about 1-2 cm in length, the shoots should be transferred to a suitable root and shoot medium. Selection pressure should be maintained in the root and shoot medium.

Typically, the transformants will develop roots in about 1-2 weeks and form plantlets. After the plantlets are about 3-5 cm in height, they are placed in sterile soil in fiber pots. Those of skill in the art will realize that different acclimation procedures are used to obtain transformed plants of different species. For example, after developing a root and shoot, cuttings, as well as somatic embryos of transformed plants, are transferred to medium for establishment of plantlets. For a description of selection and regeneration of transformed plants, see, e.g., Dodds and Roberts (1995) *Experiments in Plant Tissue Culture*, $3^{rd}$ Ed., Cambridge University Press.

There are also methods for *Agrobacterium* transformation of *Arabidopsis* using vacuum infiltration (Bechtold N., Ellis J. and Pelletier G, 1993, In planta *Agrobacterium* mediated gene transfer by infiltration of adult *Arabidopsis thaliana* plants. CR Acad Sci Paris Life Sci 316:1194-1199) and simple dipping of flowering plants (Desfeux, C., Clough S. J., and Bent A. F., 2000, Female reproductive tissues are the primary target of *Agrobacterium*-mediated transformation by the Arabidopsis floral-dip method. Plant Physiol. 123:895-904). Using these methods, transgenic seed are produced without the need for tissue culture.

There are plant varieties for which effective *Agrobacterium*-mediated transformation protocols have yet to be developed. For example, successful tissue transformation coupled with regeneration of the transformed tissue to produce a transgenic plant has not been reported for some of the most commercially relevant cotton cultivars. Nevertheless, an approach that can be used with these plants involves stably introducing the polynucleotide into a related plant variety via *Agrobacterium*-mediated transformation, confirming operability, and then transferring the transgene to the desired commercial strain using standard sexual crossing or back-crossing techniques. For example, in the case of cotton, *Agrobacterium* can be used to transform a Coker line of *Gossypium hirustum* (e.g., Coker lines 310, 312, 5110 Deltapine 61 or Stoneville 213), and then the transgene can be introduced into another more commercially relevant *G. hirustum* cultivar by back-crossing.

The transgenic plants of this invention can be characterized either genotypically or phenotypically to determine the presence of the GAT polynucleotide of the invention. Genotypic analysis can be performed by any of a number of well-known techniques, including PCR amplification of genomic DNA and hybridization of genomic DNA with specific labeled probes. Phenotypic analysis includes, e.g., survival of plants or plant tissues exposed to a selected herbicide such as glyphosate.

One of skill will recognize that after the expression cassette containing the GAT gene is stably incorporated in transgenic plants and confirmed to be operable, it can be introduced into other plants by sexual crossing. Any of a number of standard breeding techniques can be used, depending upon the species to be crossed.

In vegetatively propagated crops, mature transgenic plants can be propagated by the taking of cuttings or by tissue culture techniques to produce multiple identical plants. Selection of desirable transgenics is made and new varieties are obtained and propagated vegetatively for commercial use. In seed propagated crops, mature transgenic plants can be self crossed to produce a homozygous inbred plant. The inbred plant produces seed containing the newly introduced heterologous nucleic acid. These seeds can be grown to produce plants that would produce the selected phenotype.

Parts obtained from the regenerated plant, such as flowers, seeds, leaves, branches, fruit, and the like are included in the invention, provided that these parts comprise cells comprising the isolated GAT nucleic acid. Progeny and variants, and mutants of the regenerated plants are also included within the scope of the invention, provided that these parts comprise the introduced nucleic acid sequences.

Transgenic plants expressing a selectable marker can be screened for transmission of the GAT nucleic acid, for example, by standard immunoblot and DNA detection techniques. Transgenic lines are also typically evaluated on levels of expression of the heterologous nucleic acid. Expression at the RNA level can be determined initially to identify and quantitate expression-positive plants. Standard techniques for RNA analysis can be employed and include PCR amplification assays using oligonucleotide primers designed to amplify only the heterologous RNA templates and solution hybridization assays using heterologous nucleic acid-specific probes. The RNA-positive plants can then be analyzed for protein expression by Western immunoblot analysis using the specifically reactive antibodies of the present invention. In addition, in situ hybridization and immunocytochemistry according to standard protocols can be done using heterologous nucleic acid specific polynucleotide probes and antibodies, respectively, to localize sites of expression within transgenic tissue. Generally, a number of transgenic lines are usually screened for the incorporated nucleic acid to identify and select plants with the most appropriate expression profiles.

A preferred embodiment is a transgenic plant that is homozygous for the added heterologous nucleic acid; i.e., a transgenic plant that contains two added nucleic acid sequences, one gene at the same locus on each chromosome of a chromosome pair. A homozygous transgenic plant can be obtained by sexually mating (selfing) a heterozygous transgenic plant that contains a single added heterologous nucleic acid, germinating some of the seed produced and analyzing the resulting plants produced for altered cell division relative to a control plant (i.e., native, non-transgenic). Back-crossing to a parental plant and out-crossing with a non-transgenic plant are also contemplated.

Essentially any plant can be transformed with the GAT polynucleotides of the invention. Suitable plants for the transformation and expression of the novel GAT polynucleotides of this invention include agronomically and horticulturally important species. Such species include, but are not restricted to members of the families: Graminae (including corn, rye, triticale, barley, millet, rice, wheat, oats, etc.); Leguminosae (including pea, beans, lentil, peanut, yam bean, cowpeas, velvet beans, soybean, clover, alfalfa, lupine, vetch, lotus, sweet clover, wisteria, and sweetpea); Compositae (the largest family of vascular plants, including at least 1,000 genera, including important commercial crops such as sunflower); and Rosaciae (including raspberry, apricot, almond, peach, rose, etc.); as well as nut plants (including, walnut, pecan, hazelnut, etc.); and forest trees (including *Pinus, Quercus, Pseutotsuga, Sequoia, Populus,* etc.)

Additional targets for modification by the GAT polynucleotides of the invention, as well as those specified above, include plants from the genera: *Agrostis, Allium, Antirrhinum, Apium, Arachis, Asparagus, Atropa, Avena* (e.g., oats), *Bambusa, Brassica, Bromus, Browaalia, Camellia, Cannabis, Capsicum, Cicer, Chenopodium, Chichorium, Citrus, Coffea, Coix, Cucumis, Curcubita, Cynodon, Dactylis, Datura, Daucus, Digitalis, Dioscorea, Elaeis, Eleusine, Festuca, Fragaria, Geranium, Gossypium, Glycine, Helianthus, Heterocallis, Hevea, Hordeum* (e.g., barley), *Hyoscyamus, Ipomoea, Lactuca, Lens, Lilium, Linum, Lolium, Lotus, Lycopersicon, Majorana, Malus, Mangifera, Manihot, Medicago, Nemesia, Nicotiana, Onobrychis, Oryza* (e.g., rice), *Panicum, Pelargonium, Pennisetum* (e.g., millet), *Petunia, Pisum, Phaseolus, Phleum, Poa, Prunus, Ranunculus, Raphanus, Ribes, Ricinus, Rubus, Saccharum, Salpiglossis, Secale* (e.g., rye), *Senecio, Setaria, Sinapis, Solanum, Sorghum, Stenotaphrum, Theobroma, Trifolium, Trigonella, Triticum* (e.g., wheat), *Vicia, Vigna, Vitis, Zea* (e.g., corn), and the *Olyreae,* the *Pharoideae* and many others. As noted, plants in the family Graminae are particularly desirable target plants for the methods of the invention.

Common crop plants which are targets of the present invention include corn, rice, triticale, rye, cotton, soybean, sorghum, wheat, oats, barley, millet, sunflower, canola, peas, beans, lentils, peanuts, yam beans, cowpeas, velvet beans, clover, alfalfa, lupine, vetch, lotus, sweet clover, wisteria, sweetpea and nut plants (e.g., walnut, pecan, etc).

In one aspect, the invention provides a method for producing a crop by growing a crop plant that is glyphosate-tolerant as a result of being transformed with a gene encoding a glyphosate N-acetyltransferase, under conditions such that the crop plant produces a crop, and harvesting the crop. Preferably, glyphosate is applied to the plant, or in the vicinity of the plant, at a concentration effective to control weeds without preventing the transgenic crop plant from growing and producing the crop. The application of glyphosate can be before planting, or at any time after planting up to and including the time of harvest. Glyphosate can be applied once or multiple times. The timing of glyphosate application, amount applied, mode of application, and other parameters will vary based upon the specific nature of the crop plant and the growing environment, and can be readily determined by one of skill in the art. The invention further provides a crop produced by this method.

The invention provides for the propagation of a plant containing a GAT polynucleotide transgene. The plant can be, for example, a monocot or a dicot. In one aspect, propagation entails crossing a plant containing a GAT polynucleotide transgene with a second plant, such that at least some progeny of the cross display glyphosate tolerance.

In one aspect, the invention provides a method for selectively controlling weeds in a field where a crop is being grown. The method involves planting crop seeds or plants that are glyphosate-tolerant as a result of being transformed with a gene encoding a GAT, e.g., a GAT polynucleotide, and applying to the crop and any weeds a sufficient amount of glyphosate to control the weeds without a significant adverse impact on the crop. It is important to note that it is not necessary for the crop to be totally insensitive to the herbicide, so long as the benefit derived from the inhibition of weeds outweighs any negative impact of the glyphosate or glyphosate analog on the crop or crop plant.

In another aspect, the invention provides for use of a GAT polynucleotide as a selectable marker gene. In this embodiment of the invention, the presence of the GAT polynucleotide in a cell or organism confers upon the cell or organism the detectable phenotypic trait of glyphosate resistance, thereby allowing one to select for cells or organisms that have been transformed with a gene of interest linked to the GAT polynucleotide. Thus, for example, the GAT polynucleotide can be introduced into a nucleic acid construct, e.g., a vector, thereby allowing for the identification of a host (e.g., a cell or transgenic plant) containing the nucleic acid construct by growing the host in the presence of glyphosate and selecting for the ability to survive and/or grow at a rate that is discernibly greater than a host lacking the nucleic acid construct would survive or grow. A GAT polynucleotide can be used as a selectable marker in a wide variety of hosts that are sensitive to glyphosate, including plants, most bacteria (including *E. coli*), actinomycete, yeasts, algae and fungi. One benefit of using herbicide resistance as a marker in plants, as opposed to conventional antibiotic resistance, is that it obviates the concern of some members of the public that antibiotic resistance might escape into the environment. Some experimental data from experiments demonstrating the use of a GAT polynucleotide as a selectable marker in diverse host systems are described in the Examples section of this specification.

Selection of GAT Polynucleotides Conferring Enhanced Glyphosate Resistance in Transgenic Plants.

Libraries of GAT encoding nucleic acids diversified according to the methods described herein can be selected for the ability to confer resistance to glyphosate in transgenic plants. Following one or more cycles of diversification and selection, the modified GAT genes can be used as a selection marker to facilitate the production and evaluation of transgenic plants and as a means of conferring herbicide resistance in experimental or agricultural plants. For example, after diversification of any one or more of, e.g., SEQ ID NO:1-5 to produce a library of diversified GAT polynucleotides, an initial functional evaluation can be performed by expressing the library of GAT encoding sequences in *E. coli*. The expressed GAT polypeptides can be purified, or partially purified as described above, and screened for improved kinetics by mass spectrometry. Following one or more preliminary rounds of diversification and selection, the polynucleotides encoding improved GAT polypeptides are cloned into a plant expression vector, operably linked to, e.g., a strong constitutive promoter, such as the CaMV 35S promoter. The expression vectors comprising the modified GAT nucleic acids are transformed, typically by *Agrobacterium* mediated transformation, into *Arabidopsis thaliana* host plants. For example, *Arabidopsis* hosts are readily transformed by dipping inflorescences into solutions of *Agrobacterium* and allowing them to grow and set seed. Thousands of seeds are recovered in approximately 6 weeks. The seeds are then collected in bulk from the dipped plants and germinated in soil. In this manner it is possible to generate several thousand independently transformed plants for evaluation, constituting a high throughput (HTP) plant transformation format. Bulk grown seedlings are sprayed with glyphosate and surviving seedlings exhibiting glyphosate resistance survive the selection process, whereas non-transgenic plants and plants incorporating less favorably modified GAT nucleic acids are damaged or killed by the herbicide treatment. Optionally, the GAT encoding nucleic acids conferring improved resistance to glyphosate are recovered, e.g., by PCR amplification using T-DNA primers flanking the library inserts, and used in further diversification procedures or to produce additional transgenic plants of the same or different species. If desired, additional rounds of diversification and selection can be performed using increasing concentrations of glyphosate in each subsequent selection. In this manner, GAT polynucleotides and polypeptides conferring resistance to concentrations of glyphosate useful in field conditions can be obtained.

Herbicide Resistance

The present invention provides a composition comprising two or more polynucleotides of the invention. Preferably, the GAT polynucleotides encode GAT polypeptides having different kinetic parameters, i.e., a GAT variant having a lower $K_m$ can be combined with one having a higher $k_{cat}$. In a further embodiment, the different GAT polynucleotides may be coupled to a chloroplast transit sequence or other signal sequence thereby providing GAT polypeptide expression in different cellular compartments, organelles or secretion of one or more of the GAT polypeptides.

The mechanism of glyphosate resistance of the present invention can be combined with other modes of glyphosate resistance known in the art to produce plants and plant explants with superior glyphosate resistance. For example, glyphosate-tolerant plants can be produced by inserting into the genome of the plant the capacity to produce a higher level of 5-enolpyruvylshikimate-3-phosphate synthase (EPSPS) as more fully described in U.S. Pat. Nos. 6,248,876 B1; 5,627,061; 5,804,425; 5,633,435; 5,145,783; 4,971,908; 5,312,910; 5,188,642; 4,940,835; 5,866,775; 6,225,114 B1; 6,130,366; 5,310,667; 4,535,060; 4,769,061; 5,633,448; 5,510,471; Re. 36,449; RE 37,287 E; and 5,491,288; and international publications WO 97/04103; WO 00/66746; WO 01/66704; and WO 00/66747, which are incorporated herein by reference in their entireties for all purposes. Glyphosate resistance is also imparted to plants that express a gene that encodes a glyphosate oxido-reductase enzyme as described more fully in U.S. Pat. Nos. 5,776,760 and 5,463,175, which are incorporated herein by reference in their entireties for all purposes.

Further, the mechanism of glyphosate resistance of the present invention may be combined with other modes of herbicide resistance to provide plants and plant explants that are resistant to glyphosate and one or more other herbicides. For example, the hydroxyphenylpyruvatedioxygenases are enzymes that catalyze the reaction in which para-hydroxyphenylpyruvate (HPP) is transformed into homogentisate. Molecules which inhibit this enzyme, and which bind to the enzyme in order to inhibit transformation of the HPP into homogentisate are useful as herbicides. Plants more resistant to certain herbicides are described in U.S. Pat. Nos. 6,245,968 B1; 6,268,549; and 6,069,115; and international publication WO 99/23886, which are incorporated herein by reference in their entireties for all purposes.

Sulfonylurea and imidazolinone herbicides also inhibit growth of higher plants by blocking acetolactate synthase (ALS) or acetohydroxy acid synthase (AHAS). The production of sulfonylurea and imidazolinone tolerant plants is described more fully in U.S. Pat. Nos. 5,605,011; 5,013,659; 5,141,870; 5,767,361; 5,731,180; 5,304,732; 4,761,373; 5,331,107; 5,928,937; and 5,378,824; and international publication WO 96/33270, which are incorporated herein by reference in their entireties for all purposes.

Glutamine synthetase (GS) appears to be an essential enzyme necessary for the development and life of most plant cells. Inhibitors of GS are toxic to plant cells. Glufosinate herbicides have been developed based on the toxic effect due to the inhibition of GS in plants. These herbicides are nonselective. They inhibit growth of all the different species of plants present, causing their total destruction. The development of plants containing an exogenous phosphinothricin acetyltransferase is described in U.S. Pat. Nos. 5,969,213; 5,489,520; 5,550,318; 5,874,265; 5,919,675; 5,561,236;

5,648,477; 5,646,024; 6,177,616 B1; and 5,879,903, which are incorporated herein by reference in their entireties for all purposes.

Protoporphyrinogen oxidase (protox) is necessary for the production of chlorophyll, which is necessary for all plant survival. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1; and 5,767,373; and international publication WO 01/12825, which are incorporated herein by reference in their entireties for all purposes.

Accordingly, the invention provides methods for selectively controlling weeds in a field containing a crop that involve planting the field with crop seeds or plants which are glyphosate-tolerant as a result of being transformed with a gene encoding a glyphosate N-acetyltransferase, and applying to the crop and weeds in the field a sufficient amount of glyphosate to control the weeds without significantly affecting the crop.

The invention further provides methods for controlling weeds in a field and preventing the emergence of glyphosate-resistant weeds in a field containing a crop which involve planting the field with crop seeds or plants that are glyphosate-tolerant as a result of being transformed with a gene encoding a glyphosate-N-acetyltransferase and a gene encoding a polypeptide imparting glyphosate tolerance by another mechanism, such as, a glyphosate-tolerant 5-enolpyruvylshikimate-3-phosphate synthase and/or a glyphosate-tolerant glyphosate oxido-reductase and applying to the crop and the weeds in the field a sufficient amount of glyphosate to control the weeds without significantly affecting the crop.

In a further embodiment the invention provides methods for controlling weeds in a field and preventing the emergence of herbicide resistant weeds in a field containing a crop which involve planting the field with crop seeds or plants that are glyphosate-tolerant as a result of being transformed with a gene encoding a glyphosate-N-acetyltransferase, a gene encoding a polypeptide imparting glyphosate tolerance by another mechanism, such as, a glyphosate-tolerant 5-enolpyruvylshikimate-3-phosphate synthase and/or a glyphosate-tolerant glyphosate oxido-reductase and a gene encoding a polypeptide imparting tolerance to an additional herbicide, such as, a mutated hydroxyphenylpyruvatedioxygenase, a sulfonamide-tolerant acetolactate synthase, a sulfonamide-tolerant acetohydroxy acid synthase, an imidazolinone-tolerant acetolactate synthase, an imidazolinone-tolerant acetohydroxy acid synthase, a phosphinothricin acetyltransferase and a mutated protoporphyrinogen oxidase and applying to the crop and the weeds in the field a sufficient amount of glyphosate and an additional herbicide, such as, a hydroxyphenylpyruvatedioxygenase inhibitor, sulfonamide, imidazolinone, bialaphos, phosphinothricin, azafenidin, butafenacil, sulfosate, glufosinate, and a protox inhibitor to control the weeds without significantly affecting the crop.

The invention further provides methods for controlling weeds in a field and preventing the emergence of herbicide resistant weeds in a field containing a crop which involve planting the field with crop seeds or plants that are glyphosate-tolerant as a result of being transformed with a gene encoding a glyphosate-N-acetyltransferase and a gene encoding a polypeptide imparting tolerance to an additional herbicide, such as, a mutated hydroxyphenylpyruvatedioxygenase, a sulfonamide-tolerant acetolactate synthase, a sulfonamide-tolerant acetohydroxy acid synthase, an imidazolinone-tolerant acetolactate synthase, an imidazolinone-tolerant acetohydroxy acid synthase, a phosphinothricin acetyltransferase and a mutated protoporphyrinogen oxidase and applying to the crop and the weeds in the field a sufficient amount of glyphosate and an additional herbicide, such as, a hydroxyphenylpyruvatedioxygenase inhibitor, sulfonamide, imidazolinone, bialaphos, phosphinothricin, azafenidin, butafenacil, sulfosate, glufosinate, and a protox inhibitor to control the weeds without significantly affecting the crop.

EXAMPLES

The following examples are illustrative and not limiting. One of skill will recognize a variety of non-critical parameters that can be altered to achieve essentially similar results.

Example 1

Isolating Novel Native GAT Polynucleotides

Five native GAT polynucleotides (i.e., GAT polynucleotides that occur naturally in a non-genetically modified organism) were discovered by expression cloning of sequences from *Bacillus* strains exhibiting GAT activity. Their nucleotide sequences were determined and are provided herein as SEQ ID NO: 1-5. Briefly, a collection of approximately 500 *Bacillus* and *Pseudomonas* strains were screened for native ability to N-acetylate glyphosate. Strains were grown in LB overnight, harvested by centrifugation, permeabilized in dilute toluene, and then washed and resuspended in a reaction mix containing buffer, 5 mM glyphosate, and 200 µM acetyl-CoA. The cells were incubated in the reaction mix for between 1 and 48 hours, at which time an equal volume of methanol was added to the reaction. The cells were then pelleted by centrifugation and the supernatant was filtered before analysis by parent ion mode mass spectrometry. The product of the reaction was positively identified as N-acetylglyphosate by comparing the mass spectrometry profile of the reaction mix to an N-acetylglyphosate standard as shown in FIG. 2. Product detection was dependent on inclusion of both substrates (acetyl CoA and glyphosate) and was abolished by heat denaturing the bacterial cells.

Individual GAT polynucleotides were then cloned from the identified strains by functional screening. Genomic DNA was prepared and partially digested with Sau3A1 enzyme. Fragments of approximately 4 Kb were cloned into an *E. coli* expression vector and transformed into electrocompetent *E. coli*. Individual clones exhibiting GAT activity were identified by mass spectrometry following a reaction as described previously except that the toluene wash was replaced by permeabilization with PMBS. Genomic fragments were sequenced and the putative GAT polypeptide-encoding open reading frame identified. Identity of the GAT gene was confirmed by expression of the open reading frame in *E. coli* and detection of high levels of N-acetylglyphosate produced from reaction mixtures.

Example 2

Characterization of a GAT Polypeptide Isolated from *B. licheniformis* Strain B6

Figure 4:
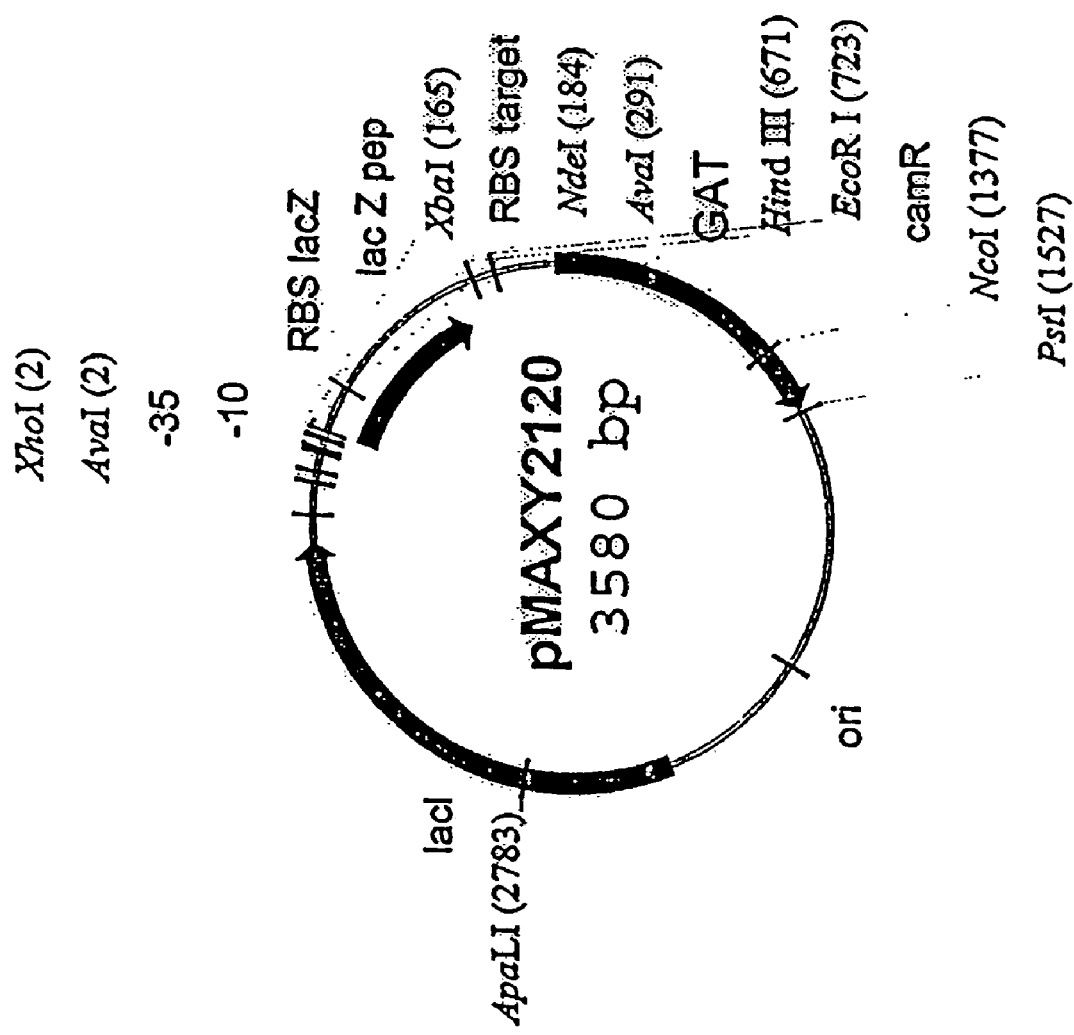
FIG. 4 is a map of the plasmid pMAXY2120 for expression and purification of the GAT enzyme from *E. coli* cultures.

Genomic DNA from *B. licheniformis* strain B6 was purified, partially digested with Sau3AI and fragments of 1-10 Kb were cloned into an *E. coli* expression vector. A clone with a 2.5 kb insert conferred the glyphosate-N-acetyltransferase (GAT) activity on the *E. coli* host as determined with mass spectrometry analysis. Sequencing of the insert revealed a single complete open reading frame of 441 base pairs. Subsequent cloning of this open reading frame confirmed that it encoded the GAT enzyme. A plasmid, pMAXY2120, is shown in FIG. 4. The gene encoding the GAT enzyme of B6 was transformed into *E. coli* strain XL1 Blue. A 10% innoculum of a saturated culture was added to Luria broth, and the culture was incubated at 37° C. for 1 hr. Expression of GAT was induced by the addition of IPTG at a concentration of 1 mM. The culture was incubated a further 4 hrs, following which, cells were harvested by centrifugation and the cell pellet stored at −80° C.

Lysis of the cells was effected by the addition of 1 ml of the following buffer to 0.2 g of cells: 25 mM HEPES, pH 7.3, 100 mM KCl and 10% methanol (HKM) plus 0.1 mM EDTA, 1 mM DTT, 1 mg/ml chicken egg lysozyme, and a protease inhibitor cocktail obtained from Sigma and used according to the manufacturer's recommendations. After 20 minutes incubation at room temperature (e.g., 22-25° C.), lysis was completed with brief sonication. The lysate was centrifuged and the supernatant was desalted by passage through Sephadex G25 equilibrated with HKM. Partial purification was obtained by affinity chromatography on CoA Agarose (Sigma). The column was equilibrated with HKM and the clarified extract was allowed to pass through under hydrostatic pressure. Non-binding proteins were removed by washing the column with HKM, and GAT was eluted with HKM containing 1 mM Coenzyme A. This procedure provided 4-fold purification. At this stage, approximately 65% of the protein staining observed on an SDS polyacrylamide gel loaded with crude lysate was due to GAT, with another 20% due to chloramphenicol acetyltransferase encoded by the vector.

Purification to homogeneity was obtained by gel filtration of the partially purified protein through Superdex 75 (Pharmacia). The mobile phase was HKM, in which GAT activity eluted at a volume corresponding to a molecular radius of 17 kD. This material was homogeneous as judged by Coomassie staining of a 3 μg sample of GAT subjected to SDS polyacrylamide gel electrophoresis on a 12% acrylamide gel, 1 mm thickness. Purification was achieved with a 6-fold increase in specific activity.

Figure 5:
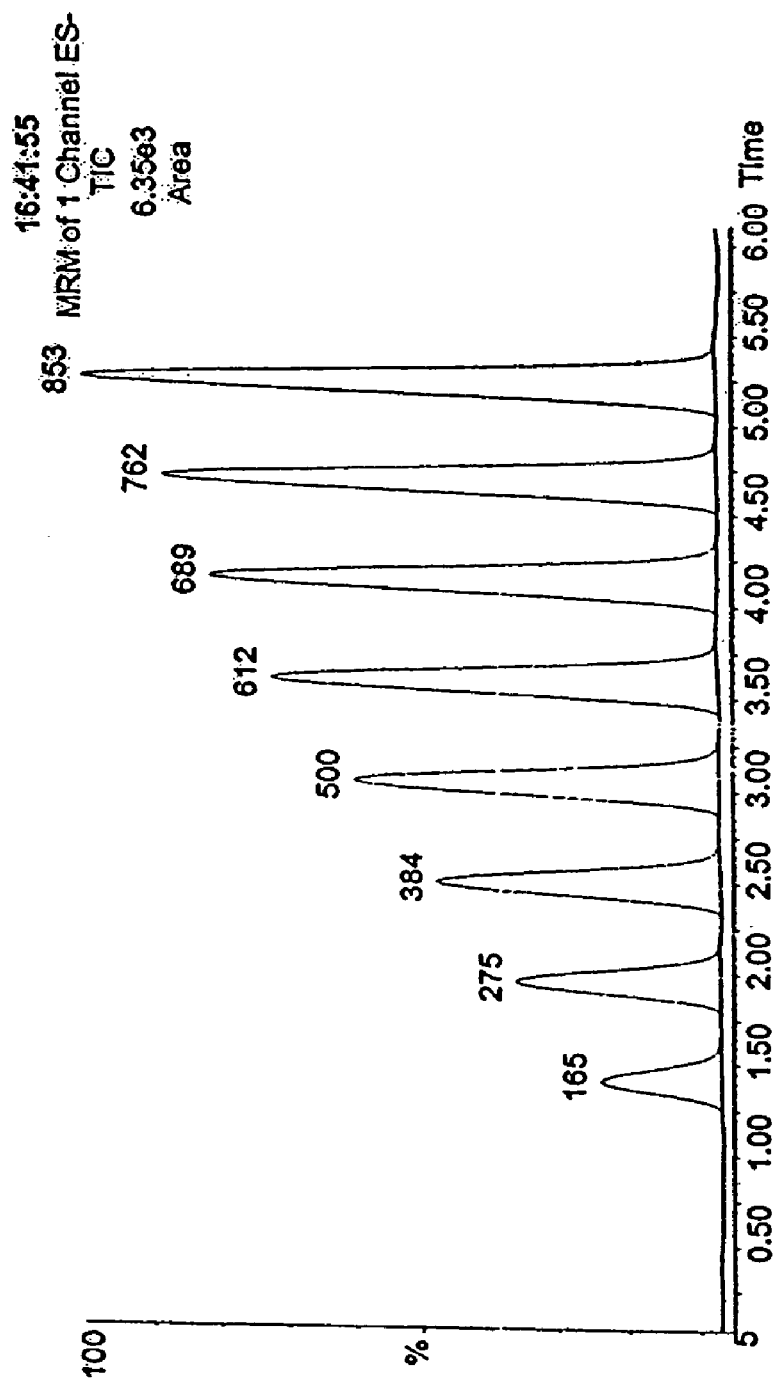
FIG. 5 is a mass spectrometry output showing increased N-acetylglyphosate production over time in a typical GAT enzyme reaction mix.

The apparent $K_M$ for glyphosate was determined on reaction mixtures containing saturating (200 μM) Acetyl CoA, varying concentrations of glyphosate, and 1 μM purified GAT in buffer containing 5 mM morpholine adjusted to pH 7.7 with acetic acid and 20% ethylene glycol. Initial reaction rates were determined by continuous monitoring of the hydrolysis of the thioester bond of Acetyl CoA at 235 nm (E=3.4 OD/mM/cm). Hyperbolic saturation kinetics were observed (FIG. 5), from which an apparent $K_M$ of 2.9±0.2 (SD) mM was obtained.

Figure 6:
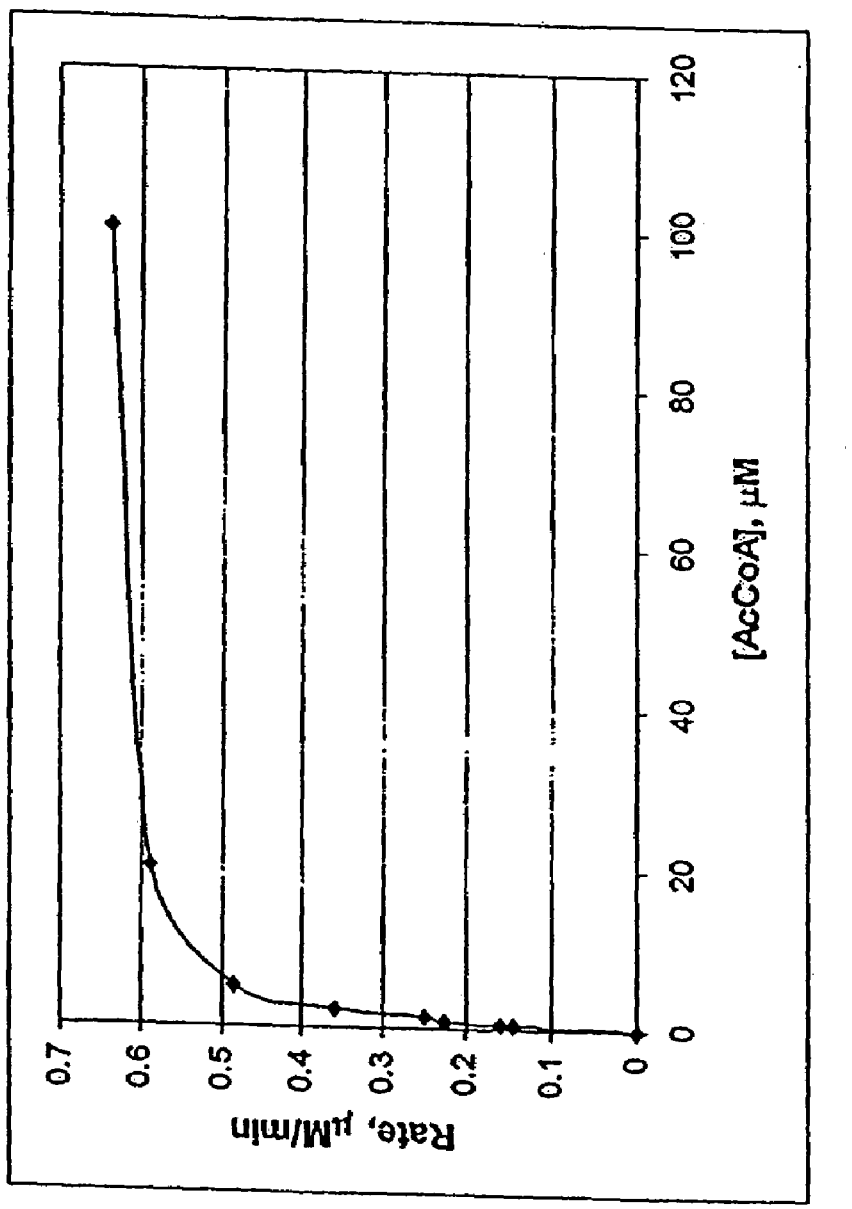
FIG. 6 is a plot of the kinetic data of a GAT enzyme from which a $K_M$ of 2.9 mM for glyphosate was calculated.
Figure 7:
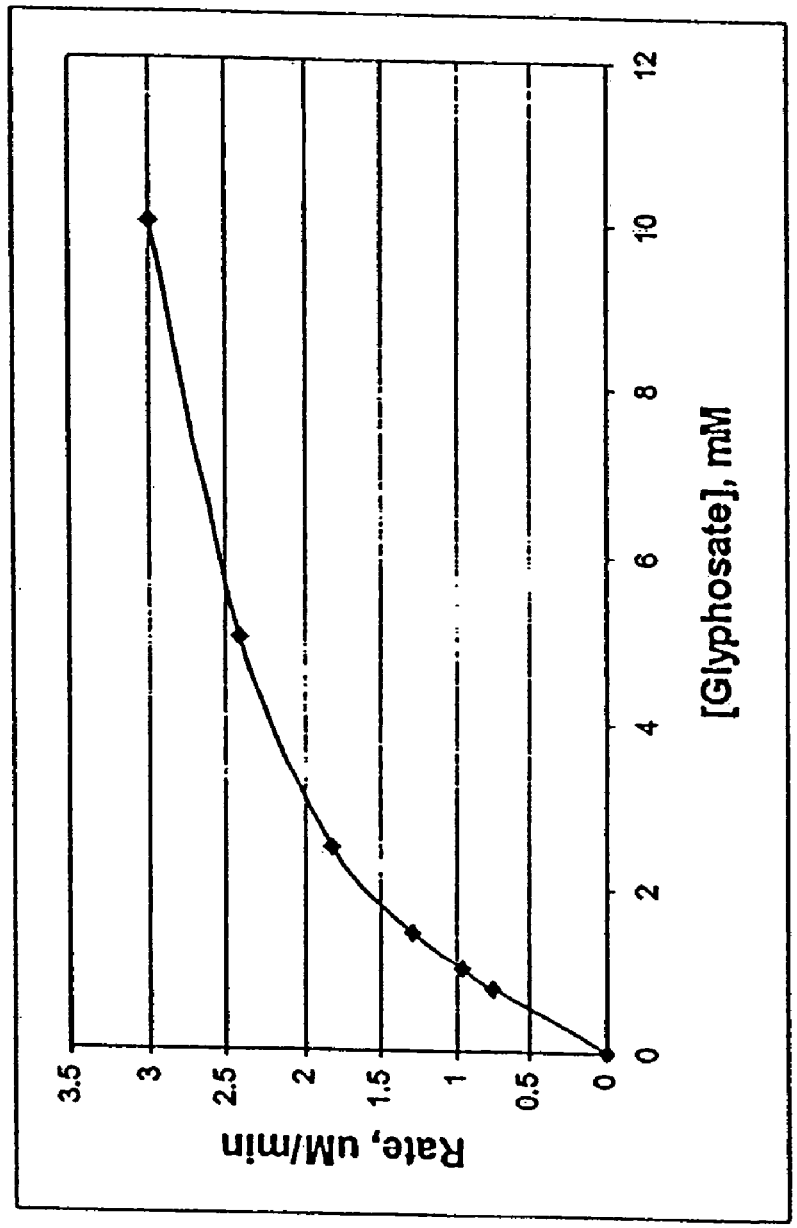
FIG. 7 is a plot of the kinetic data taken from the data of FIG. 6 from which a KM of 2 µM was calculated for Acetyl CoA.
Figure 8:
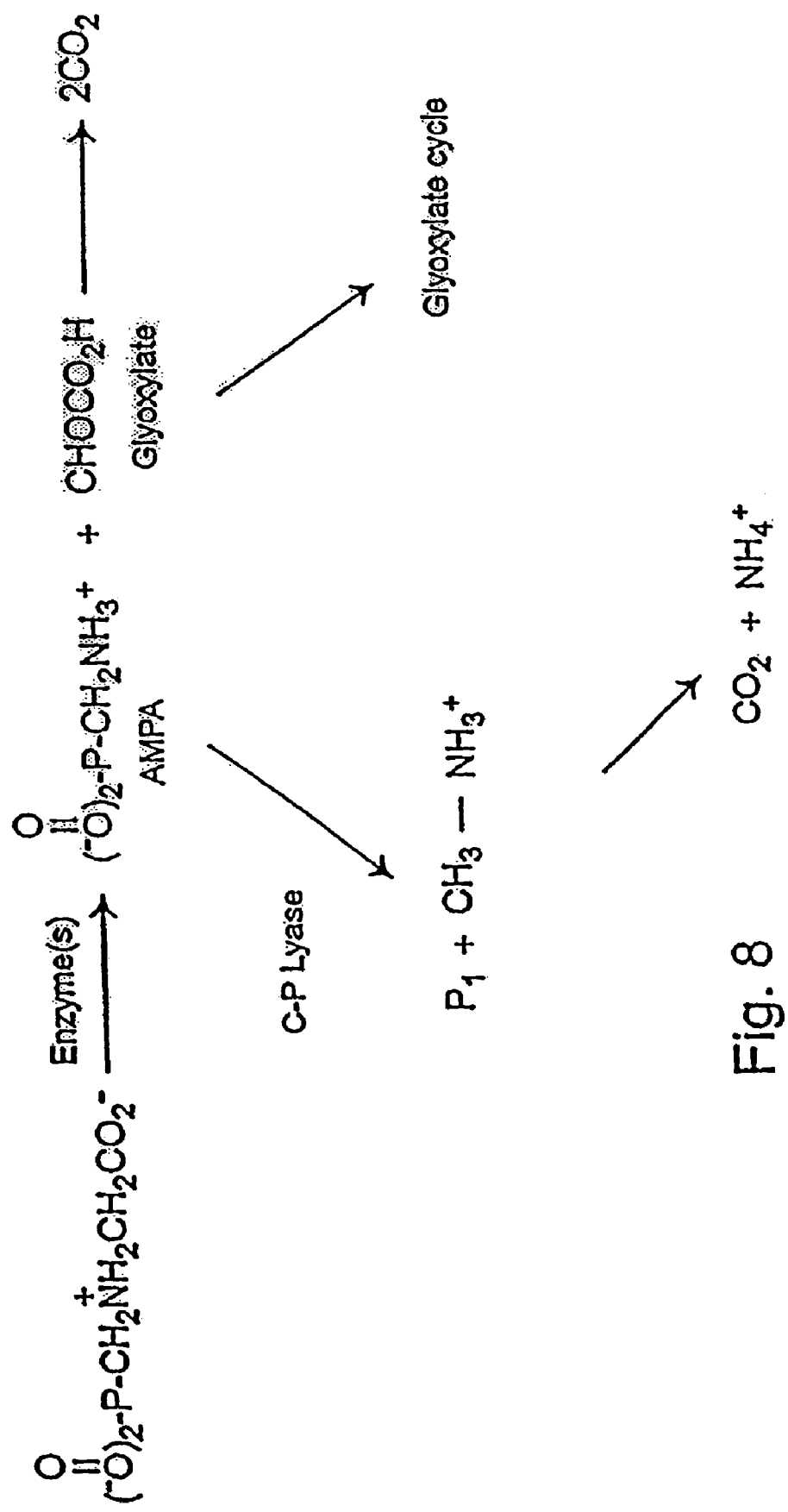
FIG. 8 is a scheme that describes the degradation of glyphosate in soil through the AMPA pathway.
Figure 9:
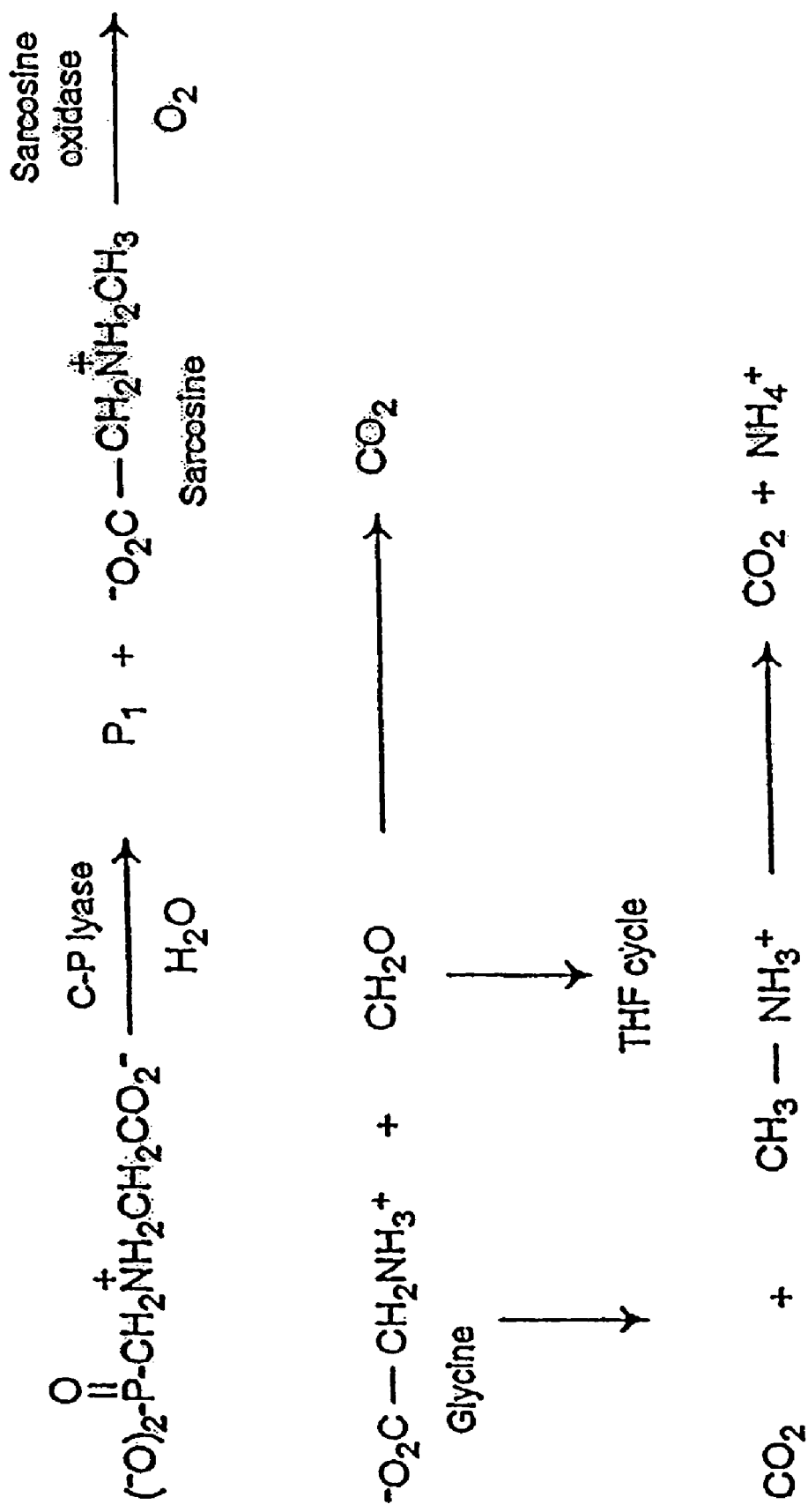
FIG. 9 is a scheme that describes the sarcosine pathway of glyphosate degradation.

The apparent $K_M$ for Acetyl CoA was determined on reaction mixtures containing 5 mM glyphosate, varying concentrations of Acetyl CoA, and 0.19 μM GAT in buffer containing 5 mM morpholine adjusted to pH 7.7 with acetic acid and 50% methanol. Initial reaction rates were determined using mass spectrometric detection of N-acetyl glyphosate. Five μl were repeatedly injected into the instrument and reaction rates were obtained by plotting reaction time vs area of the integrated peak (FIG. 6). Hyperbolic saturation kinetics were observed (FIG. 7), from which an apparent $K_M$ of 2 μM was derived. From values for $V_{max}$ obtained at a known concentration of enzyme, a $k_{cat}$ of 6/min was calculated.

Example 3

Mass Spectrometry (MS) Screening Process

Sample (5 μl) was drawn from a 96-well microtiter plate at a speed of one sample every 26 seconds and injected into the mass spectrometer (Micromass Quattro LC, triple quadrupole mass spectrometer) without any separation. The sample was carried into the mass spectrometer by a mobile phase of water/methanol (50:50) at a flow rate of 500 Ul/min. Each injected sample was ionized by a negative electrospray ionization process (needle voltage, −3.5 KV; cone voltage, 20 V; source temperature, 120° C.; desolvation temperature, 250° C.; cone gas flow, 90 L/Hr; and desolvation gas flow, 600 L/Hr). The molecular ions (m/z 210) formed during this process were selected by the first quadrupole for performing collision induced dissociation (CID) in the second quadrupole, where the pressure was set at $5\times10^{-4}$ mBar and the collision energy was adjusted to 20 Ev. The third quadrupole was set for only allowing one of the daughter ions (m/z 124) produced from the parent ions (m/z 210) to get into the detector for signal recording. The first and third quadrupoles were set at unit resolution, while the photomultiplier was operated at 650 V. Pure N-acetylglyphosate standards were used for comparison and peak integration was used to estimate concentrations. It was possible to detect less than 200 Nm N-acetylglyphosate by this method.

Example 4

Detection of Native or Low Activity GAT Enzymes

Native or low activity GAT enzymes typically have a $k_{cat}$ of approximately 1 min$^{-1}$ and a $K_M$ for glyphosate of 1.5-10 Mm. $K_M$ for acetyl CoA was typically less than 25 μM.

Bacterial cultures were grown in rich medium in deep 96-well plates and 0.5 ml stationary phase cells were harvested by centrifugation, washed with 5 mM morpholine acetate pH 8, and resuspended in 0.1 ml reaction mix containing 200 μM ammonium acetyl CoA, 5 mM ammonium glyphosate, and 5 μg/ml PMBS (Sigma) in 5 mM morpholine acetate, pH 8. The PMBS permeabilizes the cell membrane allowing the substrates and products to move from the cells to the buffer without releasing the entire cellular contents. Reactions were carried out at 25-37° C. for 1-48 hours. The reactions were quenched with an equal volume of 100% ethanol and the entire mixture was filtered on a 0.45 μm MAHV Multiscreen filter plate (Millipore). Samples were analyzed using a mass spectrometer as described above and compared to synthetic N-acetylglyphosate standards.

Example 5

Detection of High Activity GAT Enzymes

High activity GAT enzymes typically have a $k_{cat}$ up to 400 min$^{-1}$ and a $K_M$ below 0.1 mM glyphosate.

Genes coding for GAT enzymes were cloned into *E. coli* expression vector pQE80 (Qiagen) and introduced into *E. coli* strain XL1 Blue (Stratagene). Cultures were grown in 150 ul rich medium (LB with 50 ug/ml carbenicllin) in shallow U-bottom 96-well polystyrene plates to late-log phase and diluted 1:9 with fresh medium containing 1 mM IPTG (USB). After 4-8 hours induction, cells were harvested, washed with 5 mM morpholine acetate pH 6.8 and resuspended in an equal volume of the same morpholine buffer. Reactions were carried out with up to 10 ul of washed cells. At higher activity levels, the cells were first diluted up to 1:200 and 5 ul was added to 100 ul reaction mix. To measure GAT activity, the same reaction mix as described for low activity was used. However, for detecting highly active GAT enzymes the glyphosate concentration was reduced to 0.15-0.5 mM, the pH was reduced to 6.8, and reactions were carried out for 1 hour at 37° C. Reaction workup and MS detection were as described herein.

Example 6

Purification of GAT Enzymes

Enzyme purification was achieved by affinity chromatography of cell lysates on CoA-agarose and gel-filtration on Superdex-75. Quantities of purified GAT enzyme up to 10 mg were obtained as follows: A 100-ml culture of *E. coli* carrying a GAT polynucleotide on a pQE80 vector and grown overnight in LB containing 50 ug/ml carbenicillin was used to inoculate 1 L of LB plus 50 ug/ml carbenicillin. After 1 hr, IPTG was added to 1 mM, and the culture was grown a further 6 hr. Cells were harvested by centrifugation. Lysis was effected by suspending the cells in 25 mM HEPES (pH 7.2), 100 mM KCl, 10% methanol (HKM), 0.1 mM EDTA, 1 mM DTT, protease inhibitor cocktail supplied by Sigma-Aldrich and 1 mg/ml of chicken egg lysozyme. After 30 minutes at room temperature, the cells were briefly sonicated. Particulate material was removed by centrifugation, and the lysate was passed through a bed of coenzyme A-Agarose. The column was washed with several bed volumes of HKM and GAT was eluted in 1.5 bed volumes of HKM containing 1 mM acetyl CoA. GAT in the eluate was concentrated by its retention above a Centricon YM 50 ultrafiltration membrane. Further purification was obtained by passing the protein through a Superdex 75 column through a series of 0.6-ml injections. The peak of GAT activity eluted at a volume corresponding to a molecular weight of 17 kD. This method resulted in purification of GAT enzyme to homogeneity with >85% recovery. A similar procedure was used to obtain 0.1 to 0.4 mg quantities of up to 96 shuffled variants at a time. The volume of induced culture was reduced to 1 to 10 ml, coenzyme A-Agarose affinity chromatography was performed in 0.15-ml columns packed in an MAHV filter plate (Millipore) and Superdex 75 chromatography was omitted.

Example 7

Standard Protocol for Determination of $K_{CAT}$ and $K_M$ $k_{cat}$ and $K_M$ for glyphosate of purified protein were determined using a continuous spectrophotometric assay, in which hydrolysis of the sulfoester bond of Acetyl CoA was monitored at 235 nm. Reactions were performed at ambient temperature (about 23° C.) in the wells of a 96-well assay plate, with the following components present in a final volume of 0.3 ml: 20 mM HEPES, pH 6.8, 10% ethylene glycol, 0.2 mM acetyl CoA, and various concentrations of ammonium glyphosate. In comparing the kinetics of two GAT enzymes, both enzymes were assayed under the same conditions, e.g., both at 23° C. $k_{cat}$ was calculated from $V_{max}$ and the enzyme concentration, determined by Bradford assay. $K_M$ was calculated from the initial reaction rates obtained from concentrations of glyphosate ranging from 0.125 to 10 mM, using the Lineweaver-Burke transformation of the Michaelis-Menten equation. $k_{cat}/K_M$ was determined by dividing the value determined for $k_{cat}$ by the value determined for $K_M$.

Using this methodology, kinetic parameters for a number of GAT polypeptides exemplified herein were determined. For example, the $k_{cat}$, $K_M$ and $k_{cat}/K_M$ for the GAT polypeptide corresponding to SEQ ID NO:445 have been determined to be 322 min$^{-1}$, 0.5 mM and 660 mM$^{-1}$min$^{-1}$, respectively, using the assay conditions described above. The $k_{cat}$, $K_M$ and $k_{cat}/K_M$ for the GAT polypeptide corresponding to SEQ ID NO:457 have been determined to be 118 min$^{-1}$, 0.1 mM and 1184 mM$^{-1}$min$^{-1}$, respectively, using the assay conditions described above. The $k_{cat}$, $K_M$ and $k_{cat}/K_M$ for the GAT polypeptide corresponding to SEQ ID NO:300 have been determined to be 296 min$^{-1}$, 0.65 mM and 456 mM$^{-1}$min$^{-1}$, respectively, using the assay conditions described above. One of skill in the art can use these numbers to confirm that a GAT activity assay is generating kinetic parameters for a GAT suitable for comparison with the values given herein. For example, the conditions used to compare the activity of GATs should yield the same kinetic constants for SEQ ID NO: 300, 445, and 457 (within normal experimental variance) as those reported herein, when the conditions are used to compare a test GAT with the GAT polypeptides exemplified herein.

$K_M$ for Acetyl CoA was measured using the mass spectrometry method with repeated sampling during the reaction. AcetylCoA and glyphosate (ammonium salts) were placed as 50-fold-concentrated stock solutions into a well of a mass spectrometry sample plate. Reactions were initiated with the addition of enzyme appropriately diluted in a volatile buffer such as morpholine acetate or ammonium carbonate, pH 6.8 or 7.7. The sample was repeatedly injected into the instrument and initial rates were calculated from plots of retention time and peak area. $K_M$ was calculated as for glyphosate.

Example 8

Selection of Transformed *E. Coli*

Figure 11:
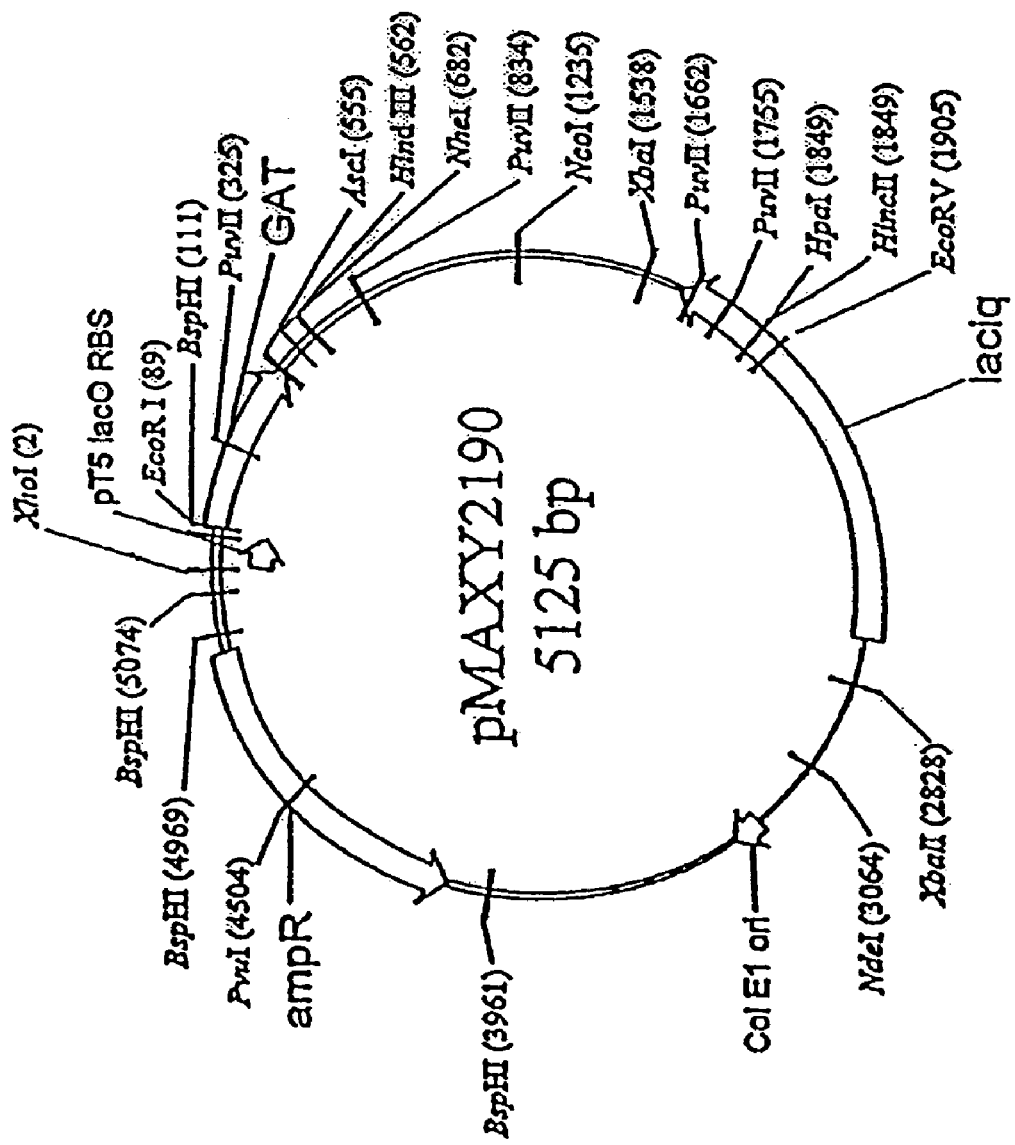
FIG. 11 is a map of the plasmid pMAXY2190.

An evolved GAT gene (a chimera with a native *B. licheniformis* ribosome binding site (AACTGAAGGAG-GAATCTC; SEQ ID NO:515) attached directly to the 5' end of the GAT coding sequence) was cloned into the expression vector pQE80 (Qiagen) between the EcoRI and HindIII sites, resulting in the plasmid pMAXY2190 (FIG. 11). This eliminated the His tag domain from the plasmid and retained the B-lactamase gene conferring resistance to the antibiotics ampicillin and carbenicillin. pMAXY2190 was electroporated (BioRad Gene Pulser) into XL1 Blue (Stratagene) *E. coli* cells. The cells were suspended in SOC rich medium and allowed to recover for one hour. The cells were then gently pelleted, washed one time with M9 minimal media lacking aromatic amino acids (12.8 g/L Na2HPO4.7H2O, 3.0 g/L KH2PO4, 0.5 g/L NaCl, 1.0 g/L NH4Cl, 0.4% glucose, 2 mM MgSO4, 0.1 mM CaCl2, 10 mg/L thiamine, 10 mg/L proline, 30 mg/L carbenicillin), and resuspended in 20 ml of the same M9 medium. After overnight growth at 37° C. at 250 rpm, equal volumes of cells were plated on either M9 medium or M9 plus 1 mM glyphosate medium. pQE80 vector with no GAT gene was similarly introduced into *E. coli* cells and plated for single colonies for comparison. Table 3 presents a summary of the results, demonstrating that GAT activity allows selection and growth of transformed *E. coli* cells with less than 1% background. Note that no IPTG induction was necessary for sufficient GAT activity to allow growth of transformed cells. Transformation was verified by re-isolation of pMAXY2190 from the *E. coli* cells grown in the presence of glyphosate.

TABLE 3

Glyphosate selection of pMAXY2190 in E. coli
Number of colonies

| Plasmid | M9 – glyphosate | M9 + 1 mM glyphosate |
|---|---|---|
| pMAXY2190 | 568 | 512 |
| pQE80 | 324 | 3 |

Example 9

Selection of Transformed Plant Cells

Figure 12:
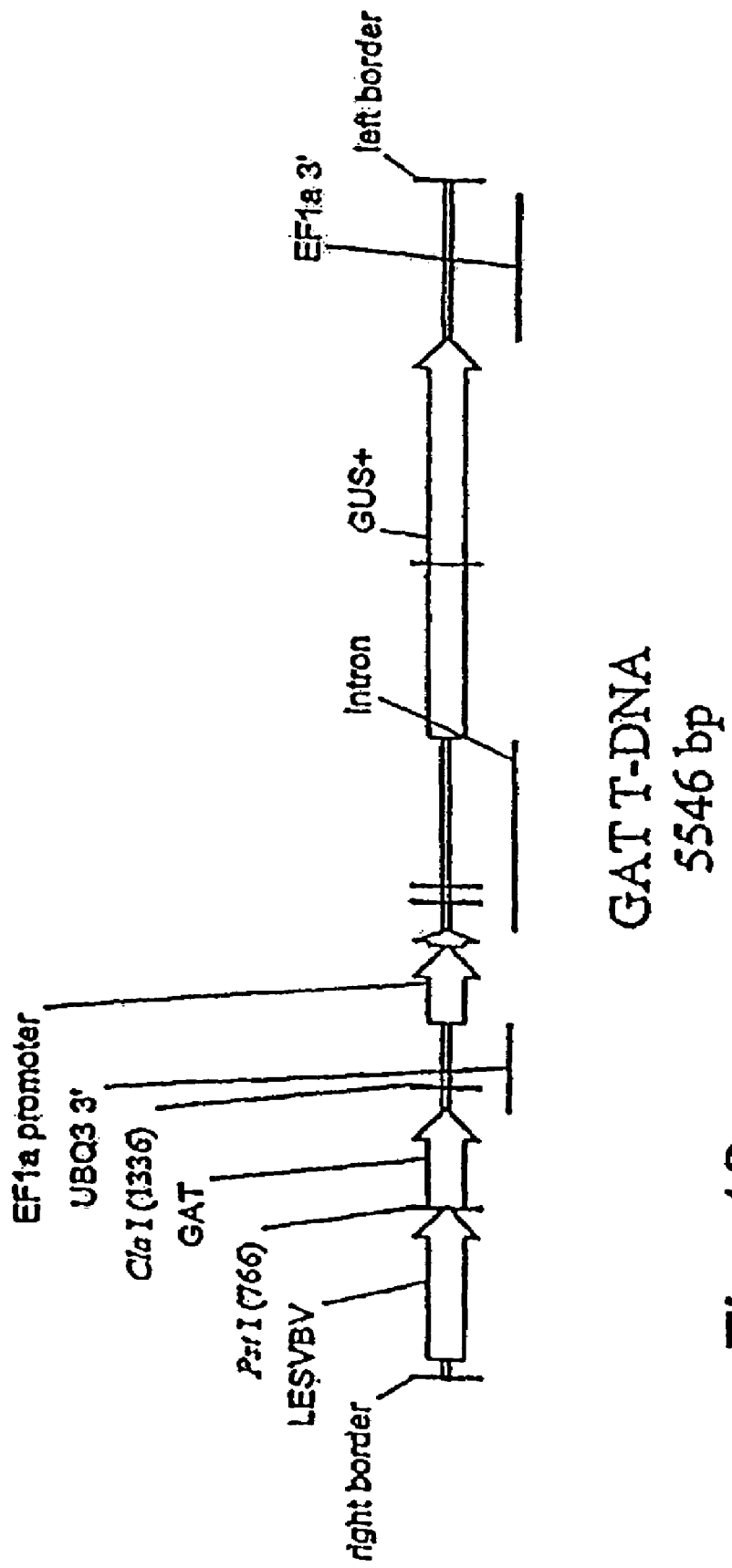
FIG. 12 depicts a T-DNA construct with gat selectable marker.

*Agrobacterium*-mediated transformation of plant cells occurs at low efficiencies. To allow propagation of transformed cells while inhibiting proliferation of non-transformed cells, a selectable marker is needed. Antibiotic markers for kanamycin and hygromycin and the herbicide modifying gene bar, which detoxifies the herbicidal compound phosphinothricin, are examples of selectable markers used in plants (Methods in Molecular Biology, 1995, 49:9-18). Here we demonstrate that GAT activity serves as an efficient selectable marker for plant transformation. An evolved GAT gene (0_5B8), SEQ ID NO:190, was cloned between a plant promoter (enhanced strawberry vein banded virus) and a ubiquinone terminator and introduced into the T-DNA region of the binary vector pMAXY3793 suitable for transformation of plant cells via *Agrobacterium tumefaciens* EHA105 as shown in FIG. 12. A screenable GUS marker was present in the T-DNA to allow confirmation of transformation. Transgenic tobacco shoots were generated using 7glyphosate as the only selecting agent.

Axillary buds of *Nicotiana tabacum* L. Xanthi were subcultured on half-strength MS medium with sucrose (1.5%) and Gelrite (0.3%) under 16-h light (35-42 µEinsteins $m^{-2}$ $s^{-1}$, cool white fluorescent lamps) at 24° C. every 2-3 weeks. Young leaves were excised from plants after 2-3 weeks subculture and were cut into 3×3 mm segments. *A. tumefaciens* EHA105 was inoculated into LB medium and grown overnight to a density of A600=1.0. Cells were pelleted at 4,000 rpm for 5 minutes and resuspended in 3 volumes of liquid co-cultivation medium composed of Murashige and Skoog (MS) medium (pH 5.2) with 2 mg/L N6-benzyladenine (BA), 1% glucose and 400 uM acetysyringone. The leaf pieces were then fully submerged in 20 ml of *A. tumefaciens* in 100×25 mm Petri dishes for 30 min, blotted with autoclaved filter paper, then placed on solid co-cultivation medium (0.3% Gelrite) and incubated as described above. After 3 days of co-cultivation, 20-30 segments were transferred to basal shoot induction (BSI) medium composed of MS solid medium (pH 5.7) with 2 mg/L BA, 3% sucrose, 0.3% Gelrite, 0-200 uM glyphosate, and 400 ug/ml Timentin.

After 3 weeks, shoots were clearly evident on the explants placed on media with no glyphosate regardless of the presence or absence of the GAT gene. T-DNA transfer from both constructs was confirmed by GUS histochemical staining of leaves from regenerated shoots. Glyphosate concentrations greater than 20 uM completely inhibited any shoot formation from the explants lacking a GAT gene. Explants infected with *A. tumefaciens* with the GAT construct regenerated shoots at glyphosate concentrations up to 200 uM (the highest level tested). Transformation was confirmed by GUS histochemical staining and by PCR fragment amplification of the GAT gene using primers annealing to the promoter and 3' regions. The results are summarized in Table 4.

TABLE 4

Tobacco shoot regeneration with glyphosate selection.
Glyphosate concentration
% Shoot Regeneration

| Transferred genes | 0 uM | 20 uM | 40 uM | 80 uM | 200 uM |
|---|---|---|---|---|---|
| GUS | 100 | 0 | 0 | 0 | 0 |
| gat and GUS | 100 | 60 | 30 | 5 | 3 |

Example 10

Glyphosate Selection of Transformed Yeast Cells

Figure 13:
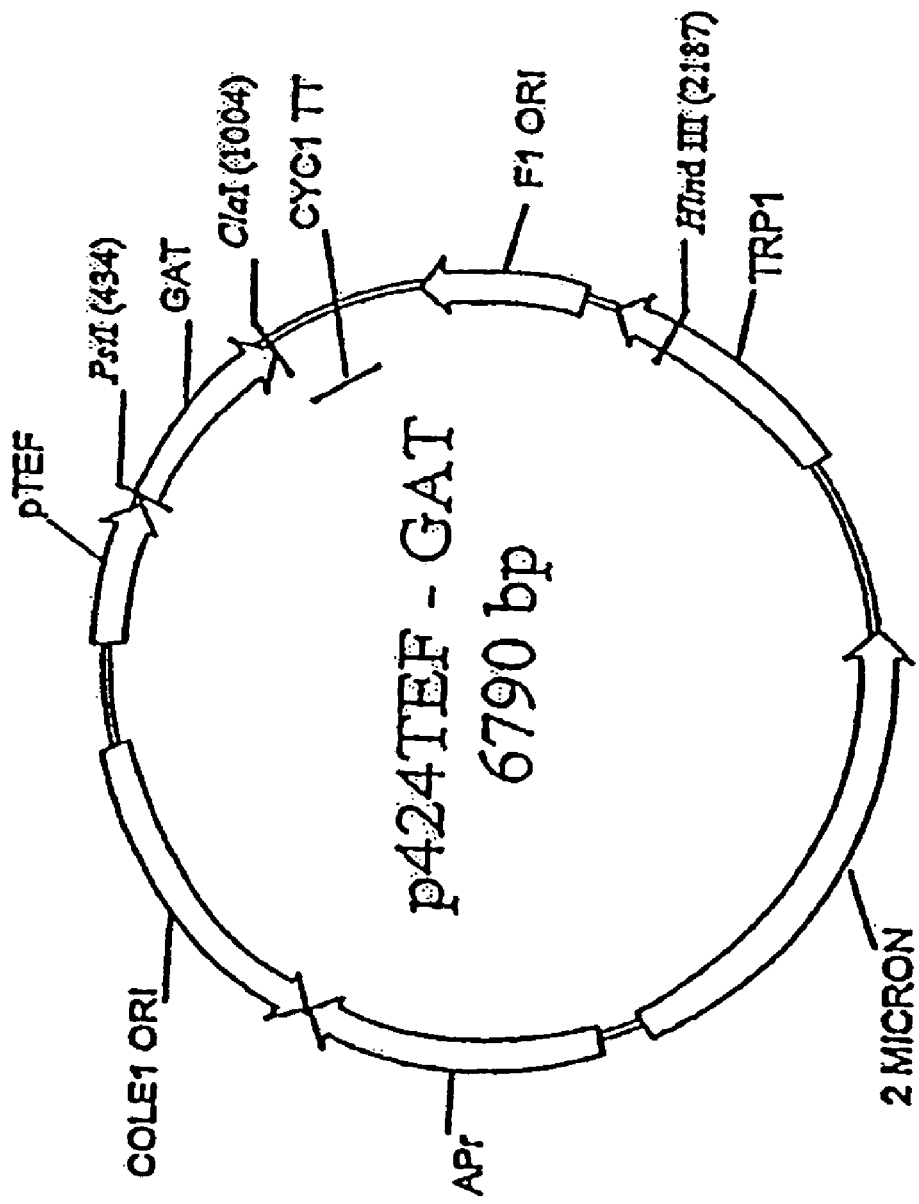
FIG. 13 depicts a yeast expression vector with gat selectable marker.

Selection markers for yeast transformation are usually auxotrophic genes that allow growth of transformed cells on a medium lacking the specific amino acid or nucleotide. Because *Saccharomyces cerevisiae* is sensitive to glyphosate, GAT can also be used as a selectable marker. To demonstrate this, an evolved GAT gene (0_6D10), SEQ ID NO:196, is cloned from the T-DNA vector pMAXY3793 (as shown in Example 9) as a PstI-ClaI fragment containing the entire coding region and ligated into PstI-ClaI digested p424TEF (Gene, 1995, 156:119-122) as shown in FIG. 13. This plasmid contains an *E. coli* origin of replication and a gene conferring carbenicillin resistance as well as a TRP1, tryptophan auxotroph selectable marker for yeast transformation.

The GAT containing construct is transformed into *E. coli* XL1 Blue (Statagene) and plated on LB carbenicillin (50 ug/ml) agar medium. Plasmid DNA is prepared and used to transform yeast strain YPH499 (Stratagene) using a transformation kit (Bio101). Equal amounts of transformed cells are plated on CSM-YNB-glucose medium (Bio101) lacking all aromatic amino acids (tryptophan, tyrosine, and phenylalanine) with added glyphosate. For comparison, p424TEF lacking the GAT gene is also introduced into YPH499 and plated as described. The results demonstrate that GAT activity function will as an efficient selectable marker. The presence of the GAT containing vector in glyphosate selected colonies can be confirmed by re-isolation of the plasmid and restriction digest analysis.

Example 11

Herbicide Spray Tests of GAT Expressing Tobacco Plants

Tobacco shoots generated as described in EXAMPLE 9 were excised from the explants and transferred to basal root induction (BRI) medium composed of half-strength Murashige and Skoog (MS) medium, pH 5.7, with 1.5% sucrose, 0.3% Gelrite, 0-200 uM glyphosate and 400 ug/ml Timentin. Rooted plants and axillary shoots were clonally propagated by cutting the stem and transferring it to fresh BRI medium until the desired number of clones was obtained. Rooted plants were carefully removed from the solid medium. Prior to placing the plants into small pots of soil, the roots were washed to remove any remaining Gelrite. A protective plastic cover was kept over the plants for at least one week until the plants were well established.

To determine if GAT expressing tobacco plants could tolerate simulated field rate sprays of glyphosate, clonal lines of several events per GAT variant were tested. A typical test was set up as follows: One clone from each event was sprayed with 1 ml of solution containing the isopropylamine salt of glyphosate (Sigma P5671) and 0.125% Triton X-100, pH 6.8 such that the amount of active ingredient sprayed was equivalent to that present in commercial glyphosate products. For example, to achieve 32 oz/acre (1X) of herbicide containing 40% active ingredient ("ai"), 2.4 ul of 40% ai formulation was diluted into 1 ml water and sprayed on a plant in a 4-inch square pot (16 in$^2$). A mock application (0X) with surfactant only was also included. In some cases a second spray was applied 1-4 weeks later. Plants were kept in controlled growth rooms at 25° C. and 70% humidity with 16 hr light.

In this example, 10 events confirmed positive for GAT0_6D10 (SEQ ID NO:196), ten for GAT0_5D3 (SEQ ID NO:193), 8 events for GAT0_5B8 (SEQ ID NO:190), and plants transformed with the vector only (no GAT) were clonally propagated, transferred to soil and sprayed when plants had an average of 5 leaves. Seed-grown wild type plants were also sprayed. After two weeks, the vector only and seed grown plants sprayed with 0.5, 2 or 4X glyphosate stopped growing, wilted, and turned brown. Each of the transgenic GAT plants survived the spraying procedure without signs of glyphosate damage such as chlorosis, leaf elongation, stunting, or browning. All 0X plants were healthy, including the non-GAT control plants. Three weeks later all of the surviving plants were sprayed with an 8X dose. The 0X control plants died within two weeks. Again, all GAT plants survived.

Tobacco plants transformed with GAT and selected on glyphosate were fertile. Flowering and seed set were not detectably different from wild type plants.

Example 12

Mendelian Inheritance of GAT Gene and Glyphosate-Tolerant Phenotype

Mendelian inheritance of the GAT gene and glyphosate-tolerant phenotype was demonstrated with transformed *Arabidopsis*. Columbia type *Arabidopsis* plants were grown and transformed by the dipping method (Clough, S J and Bent, A F, (1998) Plant J. 16(6):735-43) with a construct containing the GAT variant called chimera (SEQ ID NO:16). Bulk seed was collected and GAT plants were confirmed by PCR with primers specific to the insert within the T-DNA. T1 seed from individual events were sown on soil with 10-30 seeds per 2-inch square pot. When the first set of true leaves was emerging, pots were sprayed with glyphosate equivalent to 0.5 and 1X commercial product (as calculated in EXAMPLE 11). After two weeks, segregation of the transgene and tolerant phenotype was evident as shown in Table 5.

TABLE 5

Summary of segregation data for 0.5 and 1X glyphosate-tolerant T1 *Arabidopsis*

| Chimera event (SEQ ID NO: 16) | # Survivors | # Dead | Segregation ratio |
|---|---|---|---|
| 1 | 8 | 11 | 1:1.4 |
| 3 | 6 | 22 | 1:3.7 |
| 5 | 26 | 2 | 13:1 |
| 13 | 10 | 9 | 1:1 |
| 65 | 46 | 19 | 2.4:1 |
| Vector only | 0 | 22 | — |
| Wild-type | 0 | 29 | — |

Ratios near 3:1 indicate a single segregating dominant event. Ratios greater than 3:1 indicate several segregating inserts. Ratios less than 3:1 can be due to small sample size effects, incomplete dominance, or position effects that render expression too low to confer herbicide tolerance. Compared to the controls, it was clear that the GAT gene was transmitted to the T1 generation and conferred glyphosate tolerance.

Example 13

Production of Glyphosate-Resistant Maize Expressing GAT Transgenes

Maize plants expressing GAT variant transgenes were produced using the methods described in U.S. Pat. No. 5,981,849, which is incorporated herein by reference. Specifically, *Agrobacterium tumefaciens* vectors were constructed according to methods known in the art. Each vector contained an insert having an ubiquitin promoter and intron, a GAT variant and a PinII terminator. Maize immature embryos were excised and infected with an *Agrobacterium tumefaciens* vector containing the GAT variant of interest. After infection, embryos were transferred and cultured in co-cultivation medium. After co-cultivation, the infected immature embryos were transferred onto media containing 1.0 mM glyphosate (Roundup ULTRA MAX™). This selection lasted until actively growing putative transgenic calli were identified. The putative transgenic callus tissues were sampled for PCR and Western assay (data not shown) to confirm the presence of the GAT gene. The putative transgenic callus tissues were maintained on 1.0 mM glyphosate selection media for further growth and selection before plant regeneration. At regeneration, callus tissue confirmed to be transgenic were transferred onto maturation medium containing 0.1 mM glyphosate and cultured for somatic embryo maturation. Mature embryos were then transferred onto regeneration medium containing 0.1 mM glyphosate for shoot and root formation. After shoots and roots emerged, individual plantlets were transferred into tubes with rooting medium containing 0.1 mM glyphosate. Plantlets with established shoots and roots were transplanted into pots in the greenhouse for further growth, the generation of T0 spray data and the production of T1 seed.

In order to evaluate the level of glyphosate resistance of the transgenic maize plants expressing the GAT variant transgenes, T0 plants were sprayed with glyphosate (Roundup ULTRA MAX™) in the greenhouse. Plant resistance levels were evaluated by plant discoloration scores and plant height measurements. Plant discoloration and plant height were evaluated according to the following scales:

Discoloration Score at 1, 2, 3 and 4 Weeks After Spray with Glyphosate
  9=no leaf/stem discoloration
  7=minor leaf/stem discoloration
  5=worse leaf/stem discoloration
  3=severely discolored plant or dying plant
  1=dead plant Plant Height Measurements
  before spraying with glyphosate
  after spraying with glyphosate at 1, 2, 3 and 4 weeks
  mature plants (at tasseling)

Figure 14:
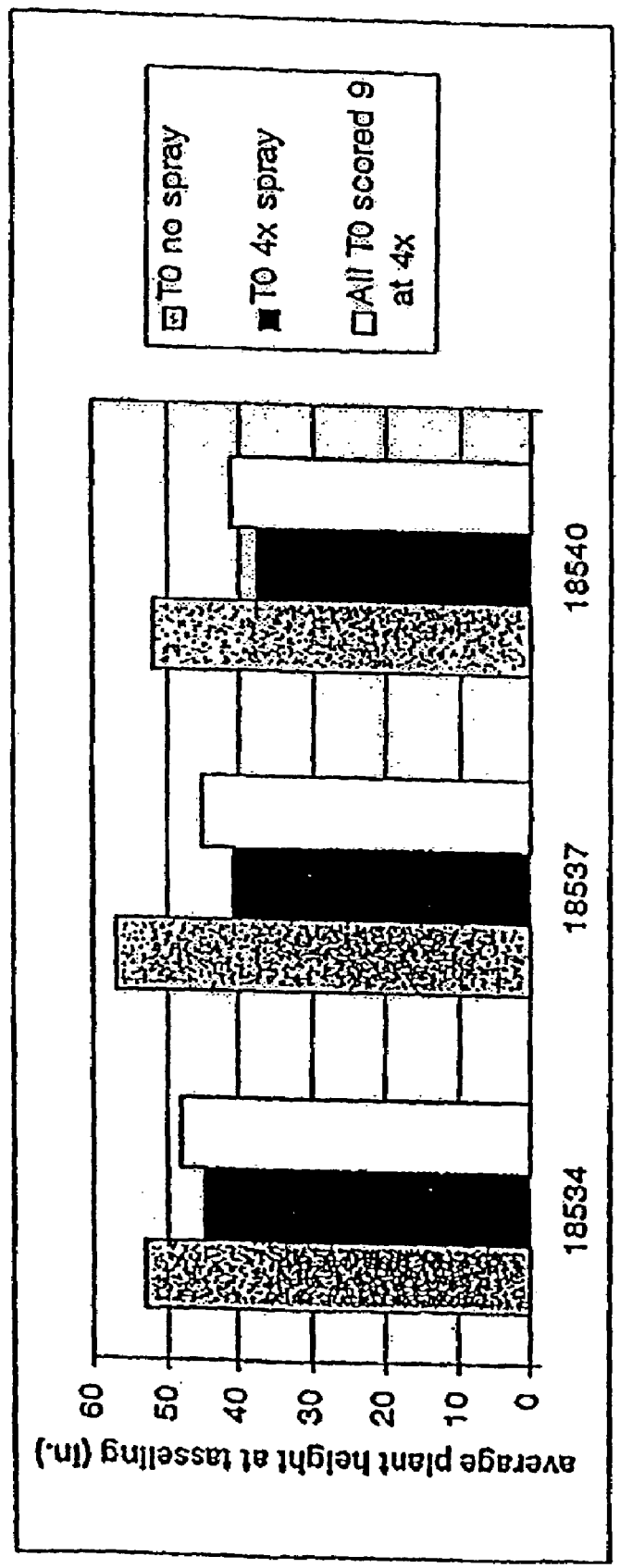
FIG. 14 illustrates effect of glyphosate on plant height at tasseling.

Two plants were sent to the greenhouse from each event (independent transgenic callus) listed in Table 6. Plant 1 was kept for seed production and was not sprayed with glyphosate. Plant 2 was sprayed at 4× glyphosate (1× glyphosate=26 ounces/acre) at 14 days after transplanting. The T0 plant discoloration scores with 4× spray at 7 and 14 days after the spray are shown in Tables 6 and 7. Height data at tasseling is shown in FIG. 14. An additional experiment was performed in which T0 plants were sprayed with 6× glyphosate. The T0 discoloration scores with 6× spray at 10 days after spray are shown in Table 8.

TABLE 6

Resistance Scores at 7 days after treatment with 4x glyphosate

| constructs | # events tested with 4x | % events @ 9 | % events @ 7 | % events @ <7 |
|---|---|---|---|---|
| 18534 (SEQ ID NO: 196) | 169 | 30% (50) | 59% (101) | 11% (18) |
| 18537 (SEQ ID NO: 193) | 72 | 40% (29) | 54% (39) | 6% (4) |
| 18540 (SEQ ID NO: 190) | 111 | 32% (36) | 61% (67) | 7% (8) |
| total | 352 | 33% (115) | 59% (207) | 8% (30) |

TABLE 7

Resistance Scores at 14 days after treatment with 4x glyphosate

| constructs | # events tested with 4x | % events @ 9 |
|---|---|---|
| 18534 (SEQ ID NO: 196) | 169 | 29%(49) |
| 18537 (SEQ ID NO: 193) | 72 | 50%(36) |
| 18540 (SEQ ID NO: 190) | 111 | 29%(32) |
| total | 352 | 33%(117) |

TABLE 8

Resistance Scores at 10 days after treatment with 6X glyphosate

| constructs | # events tested with 6X | % events with no damage after glyphosate treatment (score = 9) |
|---|---|---|
| 19286 (SEQ ID NO: 814) | 312 | 51%(160) |
| 19288 (SEQ ID NO: 549) | 310 | 52%(163) |
| 19900 (SEQ ID NO: 738) | 231 | 56%(129) |
| 19902 (SEQ ID NO: 638) | 230 | 42%(96) |
| 21895 (SEQ ID NO: 848) | 55 | 30%(17) |
| 21896 (SEQ ID NO: 912) | 61 | 61%(37) |
| 21905 (SEQ ID NO: 906) | 32 | 70%(25) |
| total | 1231 | 51%(627) |

Example 14

GAT is also an Acyltransferase

The ability of GAT variants (B6 (SEQ ID NO:7), 0_6D10 (SEQ ID NO:448), 17-15H3 (SEQ ID NO:601), and 20-8H12c (SEQ ID NO:817)) to transfer the propionyl group from propionyl CoA to glyphosate was tested in reaction mixtures containing 5 mM glyphosate or no glyphosate. Propionyl CoA was present at 1 mM. After 30 minutes the reactions were terminated and the presence of free propionyl CoA was determined by the addition of DTNB. All variants showed glyphosate-dependent hydrolysis of propionyl CoA. These results indicate that GAT also functions as an acyltransferase.

Example 15

T1 Studies of Glyphosate-Resistant Maize Expressing GAT Transgenes

Maize plants expressing GAT variant transgenes 18-28D9b (SEQ ID NO:814) and 17-15H3 (SEQ ID NO:549) were produced using the methods described in Example 13. T1 plants were used for the generation of glyphosate field tolerance data. The T1 plants were treated in the field with four different glyphosate spray treatments (0X, 4X, 8X, and 4X=4X) for each event. The plants were sprayed at V3 and V8. Plants were scored 10 days after treatment for leaf discoloration and plant height comparisons as described in Example 13. The T1 field spray data correlated well with the results previously obtained in the greenhouse as reported in Example 13. T2 seeds were collected for further studies.

Example 16

Thermostability of GAT Polypeptides

A. Effect of Temperature Variation on Glyphosate Tolerance of Glyphosate Resistant Maize Expressing GAT Transgenes
Maize plants expressing GAT variant transgenes 10_4F2 (SEQ ID NO:203), 17-15H3 (SEQ ID NO:549), and 18-28D9b (SEQ ID NO:814) were produced using the methods described in Example 13. The effect of temperature on glyphosate tolerance was evaluated in T1 plants. The T1 plants were grown in cool/cold (day 14° C., night 8° C.), warm (day 28° C., night 20° C.), and hot (day 37° C., night 20° C.) conditions. T1 plants were sprayed at V2 with four different glyphosate spray treatments (0X, 4X, 6X, and 8X). Plants were scored at 5 and 14 days after treatment for leaf discoloration and plant height comparisons as described in Example 13. Visual observations indicated that glyphosate tolerance is not adversely effected by the range of temperatures tested.

Figure 17:
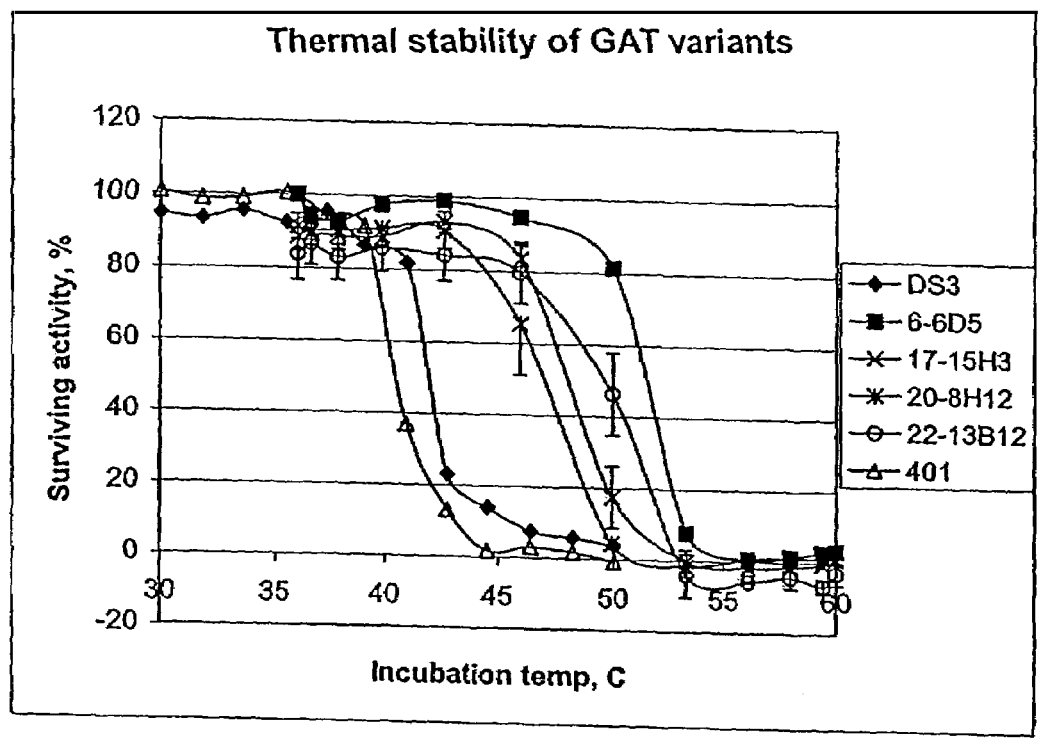
FIG. 17 depicts remaining GAT activity after incubation at various temperatures as described in Example 16.

B. Effect of Temperature Variation on GAT Activity In Vitro
In vitro thermostability of several GAT polypeptides (DS3 (a native GAT polypeptide corresponding to SEQ ID NO: 8), 6_6D5 (SEQ ID NO: 410), 17-15H3 (SEQ ID NO: 601), 20-8H12 (SEQ ID NO: 739), 22-13B12 (SEQ ID NO: 781) and 401 (a native GAT polypeptide corresponding to SEQ ID NO: 6)) was evaluated in accordance with the following method. The enzymes were distributed to 200 µl strip PCR tubes (VWR, San Francisco, Calif.) and incubated in a gradient thermocycler (ML Research, Watertown, Mass.) for 15 minutes at various temperatures between 30° C. and 60° C. as indicated in FIG. 17. Precipitated protein was removed by centrifugation, and surviving enzymatic activity of the remaining soluble protein was measured at 22° C. by the continuous spectrophotometric assay, as described in Example 7. Saturating concentrations of glyphosate (10 mM for DS3 (SEQ ID NO: 8), 401 (SEQ ID NO: 6) and 6_6D5 (SEQ ID NO: 410); 5 mM for 17-15H3 (SEQ ID NO: 601), 20-8H12 (SEQ ID NO: 739), and 22-13B12 (SEQ ID NO: 781) and AcCoA (167 µM) were used.

The data is depicted in FIG. 17. Native (i.e., wild type) GAT polypeptides DS3 (SEQ ID NO: 8) and 401 (SEQ ID NO: 6) appeared stable with respect to activity at temperatures up to about 42 to about 44° C. GAT polypeptides that are not native to any organism (i.e., not wild type) appeared stable at temperatures in the range of about 47° C. to about 54° C.

The half lives of several GAT polypeptides were also measured at 37.5° C. according to the following procedure. GAT polypeptides 401 (SEQ ID NO: 6), 17-15H3 (SEQ ID NO: 601), 20-8H12 (SEQ ID NO: 739), 22-13B12 (SEQ ID NO: 781), 22-15B4 (SEQ ID NO: 946) and 22-18C5 (SEQ ID NO: 795) were incubated in a matrix of 25 mM Hepes, pH 7.2, 10 mM KCl and 10% methanol ("HKM"). At various timepoints, aliquots were withdrawn and assayed in triplicate at 22° C. using the continuous spectrophotometric assay described in Example 7 using saturating concentrations of glyphosate (20 mM for 401, 5 mM for the rest) and AcCoA (167 uM). The standard error at each time point averaged about 2.9%. GAT activity was plotted as a function of incubation time and the data was fitted to a curve for exponential decay ($y=e^{-x}$), where y is enzyme activity and x is time in hours, from which half life was calculated. The data is shown below in Table 9.

TABLE 9

Half-lives of GAT polypeptides at 37.5 C.

| Enzyme | Half-life, hrs |
|---|---|
| 401 (SEQ ID NO: 6) | 14 |
| 17-15H3 (SEQ ID NO: 601) | 45 |
| 20-8H12 (SEQ ID NO: 739) | 54 |
| 22-13B12 (SEQ ID NO: 781) | 67 |
| 22-15B4 (SEQ ID NO: 946) | 26 |
| 22-18C5 (SEQ ID NO: 795) | 43 |

Example 17

Production of Glyphosate-Resistant Soybean Expressing GAT Transgenes

Soybean plants expressing GAT variant transgenes were produced using the method of particle gun bombardment (see Klein et al. (1987) Nature 327:70-73) using a DuPont Biolistic PDS1000/He instrument. The selection agent used during the transformation process was hygromycin. Either the hygromycin selectable marker gene remained in the transgenic events or the hygromycin gene was excised by methods known in the art. DNA fragments were prepared with a synthetic constitutive promoter, a GAT variant and PinII terminator. The selectable marker gene, comprising the 35S CaMV promoter, HPT gene and NOS terminator, was cobombarded with the GAT gene variant as described above. Bombarded soybean embryogenic suspension tissue was cultured for one week in the absence of selection agent. Embryogenic suspension tissue was placed in liquid selection medium for 6 weeks. Putative transgenic suspension tissue was sampled for PCR analysis to determine the presence of the GAT gene. Putative transgenic suspension culture tissue was maintained in selection medium for 3 weeks to obtain enough tissue for plant regeneration. Suspension tissue was matured for 4 weeks using standard procedures; matured somatic embryos were desiccated for 4-7 days and then placed on germination induction medium for 2-4 weeks. Germinated plantlets were transferred to soil in cell pack trays for 3 weeks for acclimatization. Plantlets were potted to 10-inch pots in the greenhouse for evaluation of glyphosate resistance.

To determine the level of glyphosate resistance of transgenic soybeans expressing the GAT variant transgenes, T0 plants were sprayed with glyphosate (Roundup ULTRA MAX™) in the greenhouse. Plant resistance levels were evaluated by plant discoloration scores and plant height measurements.

Discoloration Score at 2 Weeks After Spray with Glyphosate

9=no leaf/stem discoloration

7=minor leaf/stem discoloration

5=worse leaf/stem discoloration

3=severely discolored plant or dying plant

1=dead plant

One to four plants were sent to the greenhouse from each independent transgenic event. An additional 1-2 plants per event were grown in controlled environment growth chambers for seed production and were not sprayed with glyphosate. The greenhouse plants were sprayed at 1X, 2X or 4X glyphosate (1X glyphosate=26 ounces/acre of RoundUp ULTRA MAX™) 3-4 weeks after transfer to soil. The T0 plant discoloration scores with 2X and 4X spray rates are shown in Table 10 and Table 11, respectively.

These results show that soybeans are effectively transformed with GAT gene variants as confirmed by PCR analysis. Transgenic soybeans expressing GAT gene variants are resistant to glyphosate at 2X and 4X spray rates. Events surviving the 4X glyphosate spray rate do show some minor leaf discoloration however within 2 weeks of the spray test, plants recover and demonstrate normal leaf morphology.

TABLE 10

Resistance Scores at 10 days after treatment with 2X glyphosate.

| | # EVENTS TESTED WITH 2X | % EVENTS @ 7-8 | % EVENTS @ 3-6 |
|---|---|---|---|
| SEQ ID NO: 193 | 27 | 15%(4) | 11%(3) |
| SEQ ID NO: 824 | 38 | 8%(3) | 74%(23) |

TABLE 11

Resistance Scores at 10 days after treatment with 4X glyphosate.

| | # EVENTS TESTED WITH 4X | % EVENTS @ 7-8 | % EVENTS @ 3-6 |
|---|---|---|---|
| SEQ ID NO: 824 | 23 | 8%(2) | 43%(10) |

Example 18

Effect of Salt on GAT Kinetics

Figure 15A:
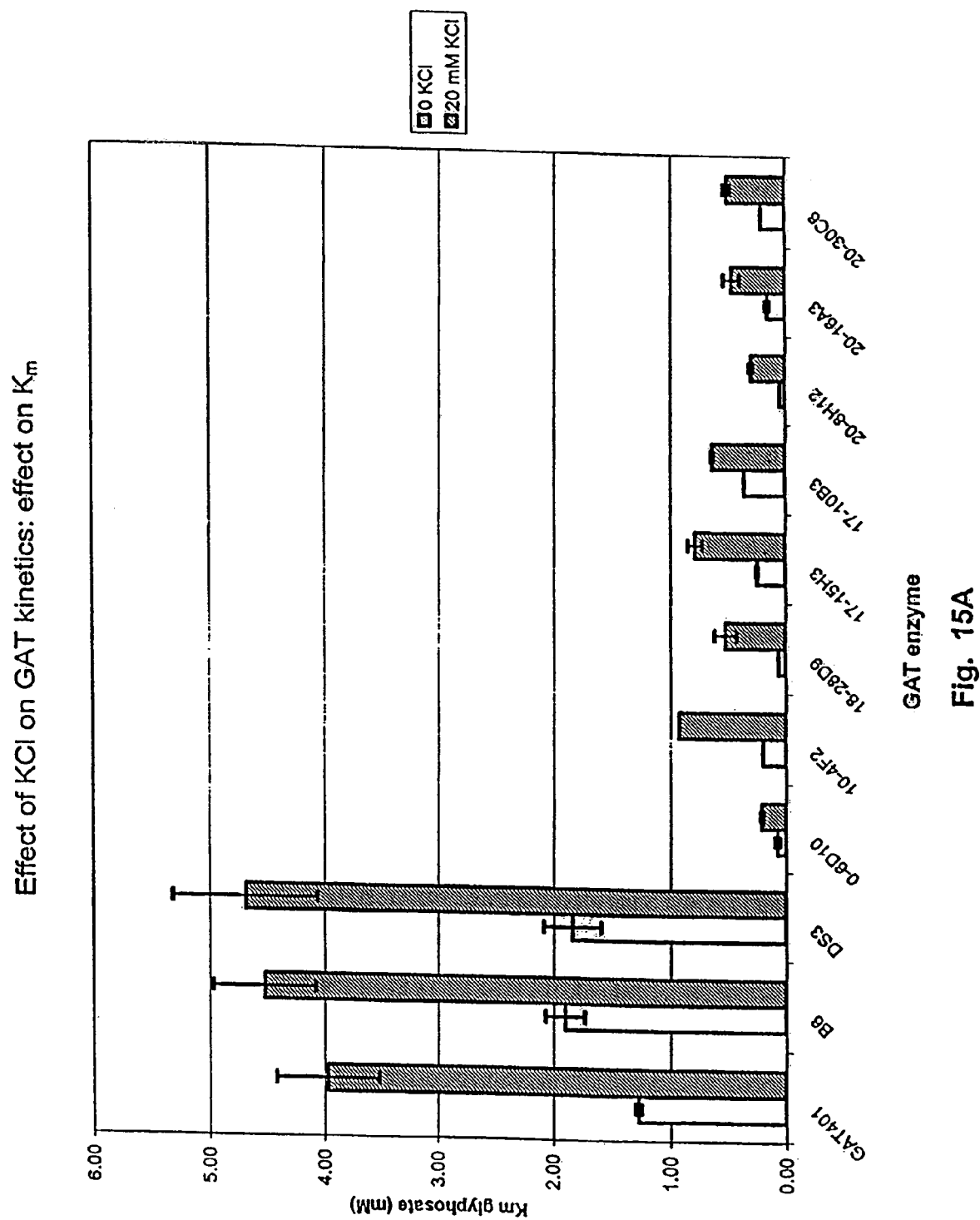
FIGS. 15A and 15B provide a comparison of the kinetic parameters $K_m$ and $k_{cat}/K_m$, respectively, for various GAT enzymes assayed in either the absence of added KCl (unshaded bars) or in the presence of 20 mM KCl (shaded bars) as described in Example 18. Error bars represent the standard deviation of multiple assays, where available.
Figure 15B:
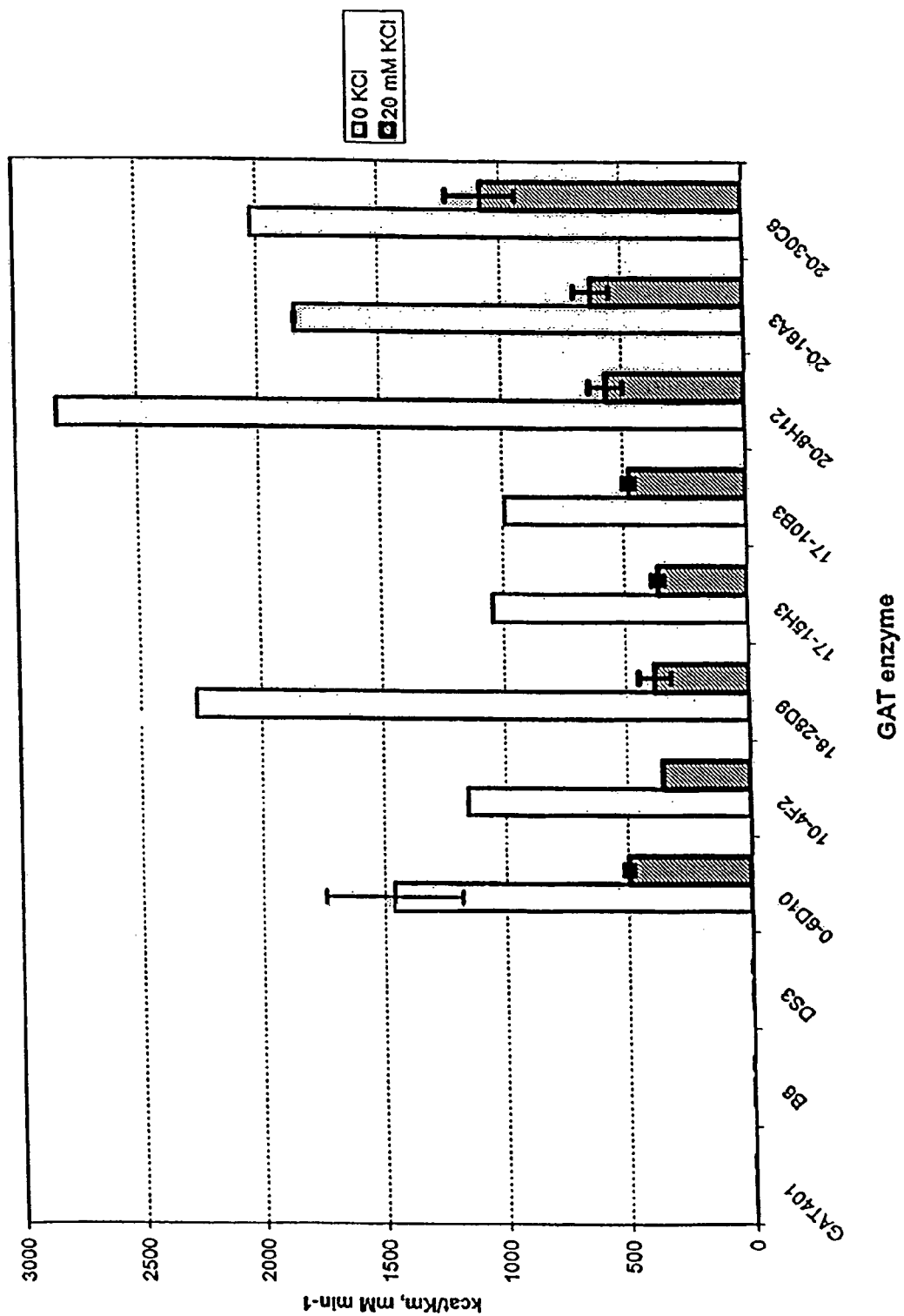

To better approximate the physiological conditions under which the GAT enzymes of the invention are intended to be used (e.g., plant cells), the activities of some GAT enzymes of the invention were re-evaluated in the presence of added salt. FIGS. 15A and 15B provide a comparison of the kinetic parameters $K_m$, and $k_{cat}/K_m$, respectively, for native GAT enzymes GAT401 (SEQ ID NO:6), B6 (SEQ ID NO:7), and DS3 (SEQ ID NO:8), and evolved GAT enzymes 0_6D10 (SEQ ID NO:448), 10_4F2 (SEQ ID NO:454), 18-28D9 (SEQ ID NO:618), 17-15H3 (SEQ ID NO:601), 17-10B3 (SEQ ID NO:592), 20-8H12 (SEQ ID NO:739), 20-16A3 (SEQ ID NO:639), and 20-30C6 (SEQ ID NO:683), assayed in either the absence of added KCl (unshaded bars) or in the presence of 20 mM KCl (shaded bars). Protein concentrations were determined using the Bradford assay as described in Example 7. Owing to their extremely low $K_m$s for glyphosate in the absence of KCl, the kinetic parameters for evolved GAT enzymes 0_6D10, 18-28D9 and 20-8H12 were determined in the absence of KCl using the mass spectrometry assay as described in Example 3, while all other kinetic parameters (either in the absence or presence of KCl) were determined using the continuous spectrophotometric assay as described in Example 7. Error bars represent the standard deviation of multiple assays, where available. FIG. 15A shows that addition of salt (20 mM KCl) to the assay buffer significantly increases the $K_m$ value for glyphosate. The $k_{cat}$ value remains relatively unchanged or increases slightly, the net result being a lower observed $k_{cat}/K_m$ value for GAT enzymes assayed in the presence of 20 mM KCl than in the absence of added KCl (FIG. 15B).

Example 19

Further Evolved GAT Genes Encoding GAT Enzymes with Extremely High Activity

Additional iterations of directed molecular evolution yielded further evolved gat genes encoding GAT enzymes exhibiting extremely high GAT activity, e.g. exhibiting one or more improved property such as reduced $K_m$ for glyphosate, increased $k_{cat}$, or increased $k_{cat}/K_m$ compared to previously-described GAT enzymes.

The further evolved gat genes were first selected for growth in *E. coli* in minimal M9 medium as described in Example 8, except that 5 mM rather than 1 mM glyphosate was used in the selection. Proteins were purified as described in Example 6 above.

Protein concentrations were determined by UV absorbance at 205 nm. The extinction coefficient was determined by the method described by Scopes (1994; Protein Purification, Principles and Practice, Springer, N.Y.) according to the formula E (mg ml$^{-1}$ cm$^{-1}$)=27+120($A_{280}/A_{205}$)=30.5. Prior to quantitation by UV absorbance the protein solution was buffer-exchanged into 50 mM $Na_2SO_4$ using a NAP-5 column (Amersham-Pharmacia Biotech).

Exemplary further evolved gat coding sequences comprise nucleic acids sequences identified herein as SEQ ID NOs: 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, and 930, which encode further evolved GAT enzymes comprising amino acid sequences identified herein as SEQ ID NOs: 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, and 931, respectively. Some such further evolved GAT enzymes exhibit extremely high GAT activity, in that they exhibit one or more improved property such as reduced $K_m$ for glyphosate, increased $k_{cat}$, or increased $k_{cat}/K_m$, compared to previously-described GAT enzymes assayed under the same conditions.

Figure 16A:
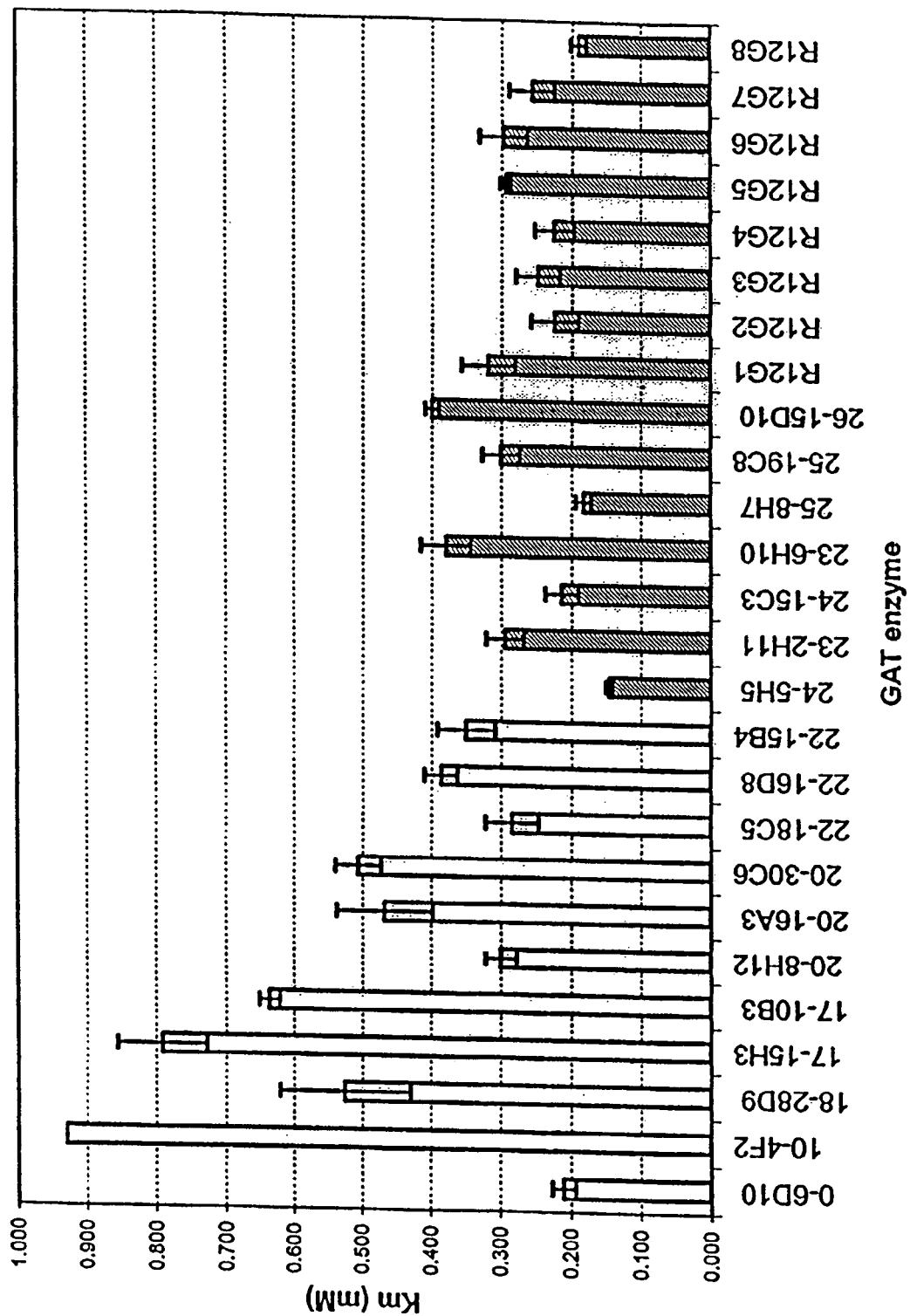
FIGS. 16A, 16B and 16C provide a comparison of the kinetic parameters $K_m$, $k_{cat}$, and $k_{cat}/K_m$, respectively, of various GAT enzymes of the invention (unshaded bars) to the kinetic parameters of some further evolved GAT enzymes of the invention (shaded bars), as described in Example 19. Error bars represent the standard deviation of multiple assays, where available.
Figure 16B:
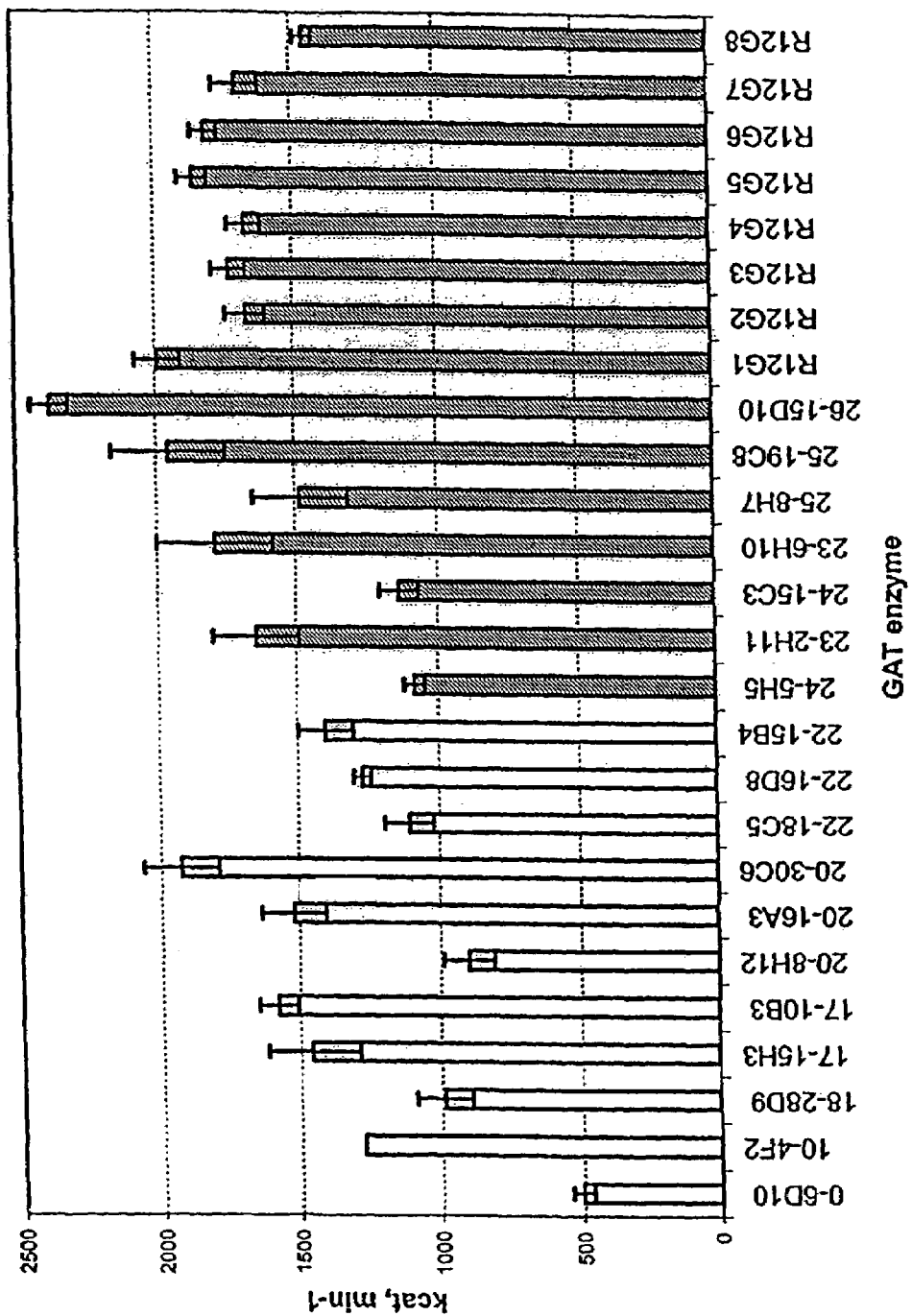
Figure 16C:
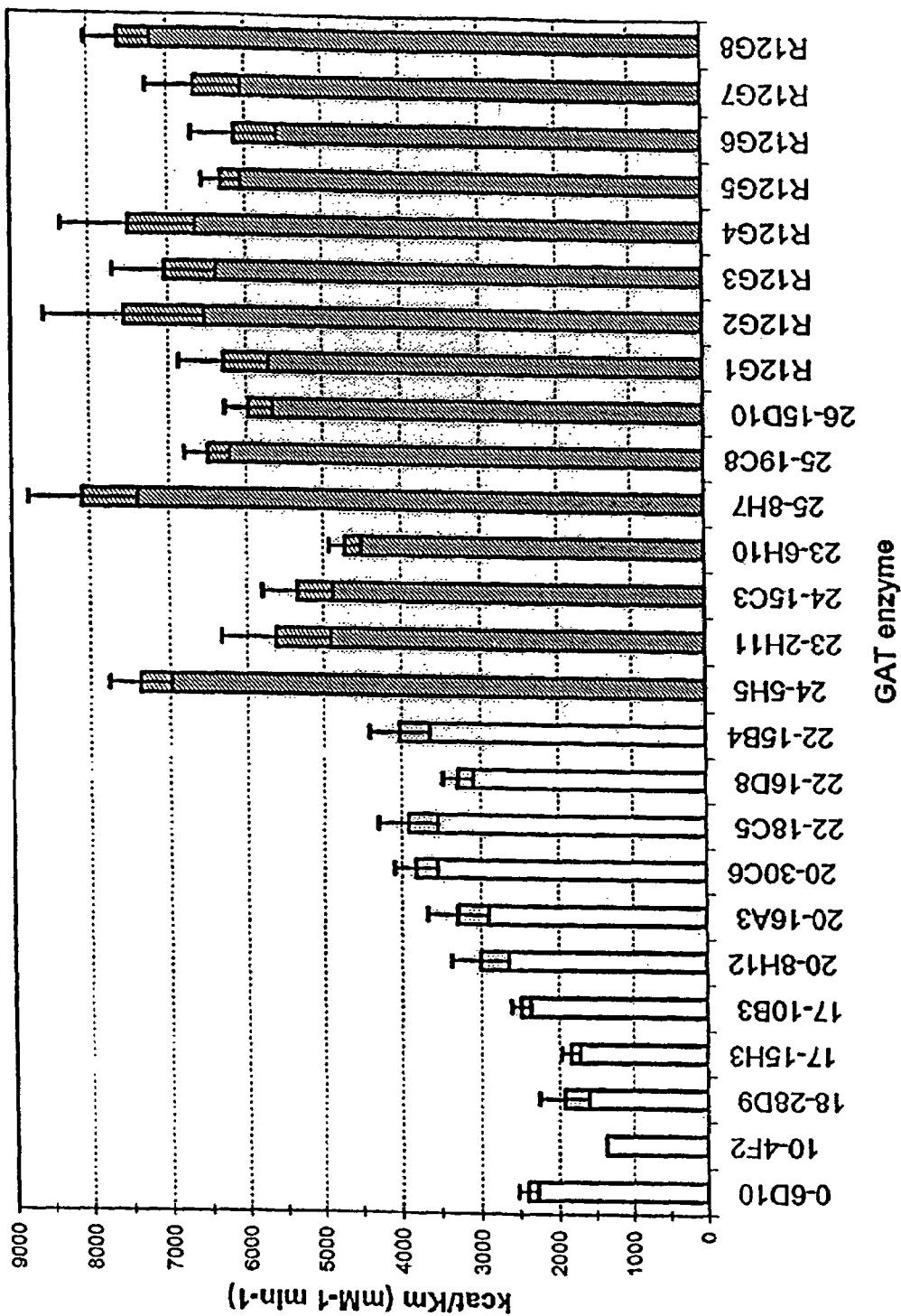

FIGS. 16A, 16B and 16C provide a comparison of the kinetic parameters $K_m$, $k_{cat}$, and $k_{cat}/K_m$, respectively, of several previously-described GAT enzymes (unshaded bars) to the kinetic parameters of some further evolved GAT enzymes of the invention (shaded bars), assayed using the continuous spectrophotometric assay in the presence of 20 mM KCl with protein quantified via UV absorbance as described above. Error bars represent the standard deviation of multiple assays, where available. Under these assay conditions, native GAT enzyme GAT401 (SEQ ID NO:6) exhibited a $K_m$ for glyphosate of about 4 mM, a $k_{cat}$ of about 5.4 min$^{-1}$, and a $k_{cat}/K_m$ of about 1.35 mM$^{-1}$ min$^{-1}$. When assayed under these conditions, some further evolved GAT enzymes of the invention (shaded bars) exhibit a range of $K_m$ values for glyphosate of less than about 0.4 mM (such as, between about 0.4 mM and 0.1 mM), $k_{cat}$ values of at least about 1000 min$^{-1}$ (such as, between about 1000 min$^{-1}$ and about 2500 min$^{-1}$), and $k_{cat}/K_m$ values of at least about 4800 mM$^{-1}$ min$^{-1}$ (such as, between about 4800 mM$^{-1}$ min$^{-1}$ and about 8000 mM$^{-1}$ min$^{-1}$). For example, some further evolved GAT enzymes of the invention exhibit at least about a 7000-fold increase in $k_{cat}/K_m$ over native GAT enzyme GAT401 under these assay conditions.

Some further evolved GAT enzymes of the invention comprise one or more amino acid residue positions not observed in previously described GAT polypeptides and GAT enzymes, such as, at position 27, a B1, Z1 or A amino acid residue; at position 33, an N or G amino acid residue; at position 46, a B2, Z4, or H amino acid residue; and at position 93, an R amino acid residue; where B1 is an amino acid selected from the group consisting of A, I, L, M, F, W, Y and V; B2 is an amino acid selected from the group consisting of R, N, D, C, Q, E, G, H, K, P, S, and T; Z1 is an amino acid selected from the group consisting of A, I, L, M and V; and Z4 is an amino acid selected from the group consisting of R, H and K. For example, some further evolved GAT enzymes of the invention comprise one or more of: an Ala at position 27 (i.e., Ala27); an Asn or a Gly at position 33 (i.e., Asn33 or Gly33); a His at position 46 (i.e., His46); and an Arg at position 93 (i.e., Arg93), with sequence numbering corresponding to that of, e.g., SEQ ID NO: 907.

Sequence/activity analyses were performed to identify amino acid residues which correlate positively with a high $k_{cat}/K_m$ (as manifested by a high $k_{cat}$, a low $K_m$, or both). Amino acid residues which appear to correlate positively with a high $k_{cat}/K_m$ include Glu14, Asp32, Asn33, Gly38, and Thr62 (sequence numbering corresponding to that of SEQ ID NO:907). Additional GAT enzymes may be constructed by substituting codons for one or more of these residues into the appropriate position(s) of a coding sequence of a template GAT polypeptide. For example, additional GAT enzymes were generated by substituting one or more of codons encoding Glu at codon position 14, Asp at position 32, Asn at position 33, Gly at position 38, and Thr at position 62, into a nucleic acid sequence encoding a template polypeptide, such as GAT 24-5H5 (SEQ ID NO:845) or GAT 25-8H7 (SEQ ID NO:907), two of the further evolved GAT enzymes exhibiting extremely high activity as described above. Exemplary further evolved GAT enzymes generated in this manner, identified herein as R12G1 (SEQ ID NOs917), R12G2 (SEQ ID NO:919), R12G3 (SEQ ID NO:921), R12G4 (SEQ ID NO:923), R12G5 (SEQ ID NO:925), R12G6 (SEQ ID NO:927), R12G7 (SEQ ID NO:929), and R12G8 (SEQ ID NO:931), encoded by nucleic acids identified as SEQ ID NOs: 916, 918, 920, 922, 924, 926, 928, and 930, respectively, exhibited extremely high GAT activities comparable to those of the template polypeptides.

Example 20

Amino Acids that Correlate with High GAT Activity

The amino acids aspartic acid (Asp, D), histidine (His, H) and cysteine (Cys, C) are known to be associated with the active sites of various acetyltransferase enzymes. To determine if any such residues play a role in GAT activity, all D, C, and H residues of GAT20-30C6 (SEQ ID NO:683) were individually mutated to alanine (Ala, A) and the mutated enzymes assayed for N-acetylglyphosate activity. Variants containing the substitutions D34A and H41A retained only about 2%-3% of the activity of the unmodified enzyme, while the variant containing the substitution H138A exhibited essentially no measurable GAT activity. On the other hand, variants containing the substitutions H138R and H138S retained low but measurable GAT activity (particularly at pHs greater than 6.8), suggesting that His (and nominally Arg and Ser) at position 138 may serve as an active-site base.

TABLE 12

| Enzyme | 0 KCl Bradford protein assay | | | |
|---|---|---|---|---|
| | $k_{cat}$ (min$^{-1}$) | $K_m$ (mM) | $k_{cat}/K_m$ (mM$^{-1}$ min$^{-1}$) | % $k_{cat}/K_m$ of 20-30C6 |
| 20-30C6 (SEQ ID NO: 683) | 386 | 0.182 | 2122 | 100 |
| 20-30C6 H41A | 208 | 4.80 | 43 | 2.0 |
| 20-30C6 D34A | 127 | 2.33 | 54 | 2.6 |
| 20-30C6 H138A | <0.02 | nd | nd | <0.005 |
| 20-30C6 H138R | 44.3 | 17.8 | 2.49 | 0.12 |
| 20-30C6 H138S | 5.35 | 7.1 | 0.75 | 0.03 |

Example 21

Improving GAT Expression in Plants

Plants, animals, and microbes are known to have specific codon preferences that affect the efficiency of amino acid incorporation during translation of gene transcripts. Rare codons could cause problems with tRNA recruitment during translation, which could then lead to lower accumulation of the encoded protein. The original parental gat genes were from bacteria such as *Bacillus licheniformis*, and, as such, may not have an optimal codon distribution for expression in plants. Evolved gat genes of the invention have successfully been expressed in plants (see, e.g., Examples 9, 11, 13, and 17, above), yet an opportunity exists to improve protein production by increasing the translation efficiency in plants. One way to accomplish this is by substituting one or more codons in the gat coding sequence which are used infrequently in plants for codons for the same amino acid(s) which are more frequently used in plants, thereby generating silent mutations in the gat coding sequence with an unchanged sequence of the encoded protein.

Tables showing the frequency of codon usage in corn, cotton and soybeans (available, for example, from the website maintained by the Kazusa DNA Research Institute, Chiba, Japan) were compared to generate the following table (Table 13) showing codons which are, in general, more frequently or less frequently utilized in either monocot or dicot plants.

TABLE 13

| Amino acid | | Codons more frequently utilized in plants | Codons less frequently utilized in plants |
|---|---|---|---|
| Alanine | Ala A | GCA GCC GCT | GCG |
| Cysteine | Cys C | TGC TGT | |
| Aspartic acid | Asp D | GAC GAT | |
| Glutamic acid | Glu E | GAA GAG | |
| Phenylalanine | Phe F | TTC TTT | |
| Glycine | Gly G | GGA GGT | GGC GGG |
| Histidine | His H | CAC CAT | |
| Isoleucine | Ile I | ATC ATT | ATA |
| Lysine | Lys K | AAA AAG | |
| Leucine | Leu L | TTG CTC CTG CTT | CTA TTA |
| Methionine | Met M | ATG | |
| Asparagine | Asn N | AAC AAT | |
| Asparagine | Asn N | AAC AAT | |
| Proline | Pro P | CCA CCT | CCC CCG |
| Glutamine | Gln Q | CAA CAG | |
| Arginine | Arg R | AGA AGG | CGA CGC CGG CGT |
| Serine | Ser S | AGT TCA TCC TCT | AGC TCG |
| Threonine | Thr T | ACA ACC ACT | ACG |
| Valine | Val V | GTG GTT | GTA GTC |
| Tryptophan | Typ W | TGG | |
| Tyrosine | Tyr Y | TAC TAT | |

A second way to increase plant expression of microbial genes is to increase the G+C content near the initiating methionine residue. Naturally-occurring coding sequences in plants tend to contain two or three G and/or C residues immediately downstream of the ATG initiation codon (Joshi et al. (1997) Plant Mol. Biol. 35:993-1001). Introducing into the gat coding sequence one or two CG-rich codons immediately downstream of the ATG intitiation codon may create a more plant-like coding sequence and thus may enhance its expression in plants. Substitution of the second codon (isoleucine, ATA) for an alanine codon (GCG) resulted in a Ile2Ala variant with reduced $k_{cat}$ compared to the unmodified enzyme. On the other hand, insertion of an alanine codon (either GCG or GCT) between the codons for Met at codon position 1 and Ile at codon position 2 resulted in a gat coding sequence encoding a GAT enzyme containing an Ala residue inserted between the Met at position 1 and the Ile at position 2. An exemplary GAT enzyme variant containing two alanines inserted between Met1 and Ile2 denoted, identified as 22-15B4 M1MAA (to signify the insertion of two Ala residues immediately following the Met at position 1) and having the protein sequence SEQ ID NO:948, exhibited a reduced $k_{cat}$ compared to the unmodified enzyme 22-15B4 (SEQ ID NO:789). An exemplary GAT enzyme containing one alanine inserted between Met1 and Ile2, denoted 22-15B4 M1AA (to signify the insertion of an Ala residue immediately following the Met at position 1), having the protein sequence SEQ ID NO:946, exhibited essentially unaltered kinetics compared to the unmodified enzyme 22-15B4.

A general strategy for improving GAT expression in plants was developed. Evolved gat coding sequences may be altered by replacing codons less frequently utilized in plants for codons more frequently utilized in plants, for example according to the table above. Codons less frequently utilized in plants (e.g., according to the above table) should generally be avoided. In this manner at least one codon (such as, at least three codons, at least five codons, or at least least ten codons), may be changed in the gat coding sequence from codon(s) less frequently utitlized in plants to codon(s) more frequently utitlized in plants. The codons which are replaced may be located at the 5' end of the coding sequence (e.g., within the first 10 codons, within the first 20 codons, within the first 50 codons, or within the first 100 codons) of the gat coding sequence. Alternatively, the codons which are replaced may be located throughout the gat coding sequence. The more frequently utilized codons furthermore may be chosen to avoid more than about 5-10 (such as, e.g., more than about 5, more than about 6, more than about 7, more than about 8, more than about 9 or more than about 10) consecutive occurrences of G+C or of A+T within the coding sequence. The coding sequence may also be altered to contain one or two CG-rich codons immediately downstream of the ATG intitiation codon, such as, for example, by inserting an Ala codon (e.g., a frequently utilized Ala codon) immediately downstream of and adjacent to the initiating Met codon of the gat coding sequence.

Table 14 provides exemplary gat coding sequences altered as described above.

TABLE 14

| original gat coding sequence | altered gat coding sequence | | codon changes made | encoded protein |
|---|---|---|---|---|
| GAT20-8H12/ 4604 (SEQ ID NO:738) | GAT4604SR | (SEQ ID NO:932) | Ser 62 TCG -> TCT<br>Arg 111 CGG -> AGG | 20-8H12 (SEQ ID NO:739) |
| GAT22-18C5/ 4609 (SEQ ID NO:794) | GAT4609SR | (SEQ ID NO:933) | Ser 62 TCG -> TCT<br>Arg 111 CGG -> AGG | 22-18C5 (SEQ ID NO:795) |
| GAT22-16D8/ 4610 (SEQ ID NO:792) | GAT4610R | (SEQ ID NO:934) | Arg 111 CGG -> AGG | 22-16D8 (SEQ ID NO:793) |
| GAT22-15B4/ 4611 (SEQ ID NO:788) | GAT4611R | (SEQ ID NO:935) | Arg 111 CGG -> AGG | 22-15B4 (SEQ ID NO:789) |
| GAT24-5H5/ 4614 (SEQ ID NO:848) | GAT4614SR | (SEQ ID NO:936) | Ser 62 TCG -> TCT<br>Arg 111 CGG -> AGG | 24-5H5 (SEQ ID NO:849) |
| GAT24-5H5/ 4614 (SEQ ID NO:848) | GAT4614VSR | (SEQ ID NO:937) | Val 4 GTG -> GTA<br>Ser 62 TCG -> TCT<br>Arg 111 CGG -> AGG | 24-5H5 (SEQ ID NO:849) |
| GAT23-2H11/ 4615 (SEQ ID NO:836) | GAT4615R | (SEQ ID NO:938) | Arg 111 CGG -> AGG | 23-2H11 (SEQ ID NO:837) |
| GAT24-15C3/ 4616 (SEQ ID NO:862) | GAT4616R | (SEQ ID NO:939) | Arg 111 CGG -> AGG | 24-15C3 (SEQ ID NO:863) |
| GAT23-6H10/ 4617 (SEQ ID NO:844) | GAT4617R | (SEQ ID NO:940) | Arg 111 CGG -> AGG | 23-6H10 (SEQ ID NO:845) |
| GAT25-8H7/ 4618 (SEQ ID NO:906) | GAT4618SR | (SEQ ID NO:941) | Ser 62 TCG -> TCT<br>Arg 111 CGG -> AGG | 25-8H7 (SEQ ID NO:907, 957) |
| GAT25-8H7/ 4618 (SEQ ID NO:906) | GAT4618VSR | (SEQ ID NO:942) | Val 4 GTG -> GTA<br>Ser 62 TCG -> TCT<br>Arg 111 CGG -> AGG | 25-8H7 (SEQ ID NO:907) |
| GAT25-19C8/ 4619 (SEQ ID NO:912) | GAT4619SR | (SEQ ID NO:943) | Ser 62 TCG -> TCT<br>Arg 111 CGG -> AGG | 25-19C8 (SEQ ID NO:913) |
| GAT25-19C8/ 4619 (SEQ ID NO:912) | GAT4619VSR | (SEQ ID NO:944) | Val 4 GTG -> GTA<br>Ser 62 TCG -> TCT<br>Arg 111 CGG -> AGG | 25-19C8 (SEQ ID NO:913) |
| GAT22-15B4/ 4611 (SEQ ID NO:788) | GAT4611A | (SEQ ID NO:945) | Ala codon inserted between Met1 and Ile2 | 22-15B4 M1MA (SEQ ID NO:946) |
| GAT22-15B4/ 4611 (SEQ ID NO:788) | GAT4611AA | (SEQ ID NO:947) | 2 Ala codons inserted between Met1 and Ile2 | 22-15B4 M1MAA (SEQ ID NO:948) |

TABLE 14-continued

| original gat coding sequence | | altered gat coding sequence | | codon changes made | encoded protein | |
|---|---|---|---|---|---|---|
| GAT25-8H7/ 4618 | (SEQ ID NO:906) | GAT4618A | (SEQ ID NO:949) | Ala codon inserted between Met1 and Ile2 | 25-8H7 M1MA | (SEQ ID NO:950) |
| GAT25-8H7/ 4618 | (SEQ ID NO:906) | GAT4620 | (SEQ ID NO:951) | Ala codon inserted between Met1 and Ile2 and first 7 codons = more frequently utilized codons; plus Ser 62 TCG -> TCT Arg 111 CGG -> AGG | 25-8H7 M1MA | (SEQ ID NO:950) |
| GAT25-8H7/ 4618 | (SEQ ID NO:906) | GAT4621 | (SEQ ID NO:952) | Ala codon inserted between Met1 and Ile2 and more frequently utilized codons throughout | 25-8H7 M1MA | (SEQ ID NO:950) |

A binary vector with a dMMV-gat-UBQ3 cassette in the T-DNA was transformed into competent *Agrobacterium tumefaciens* strain C58 cells by electroporation (McCormac et al., Mol Biotechnol. 9:155-159, 1998). After growth on LB+40 ug/ml kanamycin plates for 2 days at 28° C., colonies were inoculated into LB+40 ug/ml kanamycin liquid medium and shaken overnight at 28° C. The *Agrobacterium* cells were collected by centrifugation at 4000 g for 10 minutes and then resuspended in a volume of 10 mM MgSO4 equivalent to the initial culture volume. This bacterial suspension was forced or "infiltrated" into the intercellular spaces of *Nicotiana benthamiana* leaves using a 1 ml plastic syringe (with no needle). By infiltrating 200-300 µl of bacterial suspension into each spot (typically 3-4 cm² in infiltrated area), 4 or more spots could be arranged on a single leaf still attached to the plant. In some cases the gat-containing *Agrobacterium* strain was diluted 5:1 or 10:1 with a second *Agrobacterium* strain lacking gat prior to infiltration. This dilution step has the effect of reducing the overall expression of the gat gene in the plant cells, thereby preventing saturation and allowing easier visualization of expression differences between variants and constructs. After 3 days the leaf material was ground, extracted in aqueous buffer, and centrifuged. The supernatant, containing the soluble proteins, was subjected to SDS-PAGE, and the gel was blotted and probed with an antiGAT polyclonal antibody.

The level of GAT protein accumulated in tobacco leaves infiltrated with the GAT4620 gene was comparable to the level of protein accumulated in leaves transformed with the unmodified GAT25-8H7/4618 gene. Tobacco leaves harboring the GAT4621 gene, on the other hand, exhibited about two-fold greater GAT protein accumulation, as a percent of total protein, compared to leaves expressing the unmodified GAT25-8H7/4618 gene.

Example 22

T1 Studies of Glyphosate-Resistant Soybean Expressing GAT Transgenes

Soybean plants expressing GAT transgene 18-28D9c (SEQ ID NO:824) were produced using the methods described in Example 17. T1 seed was collected from glyphosate sprayed T0 plants. T1 seed were germinated under greenhouse conditions in RediEarth$^R$360 medium, available from Scotts, Marysville, Ohio, and sprayed at V2-V3 stage with either 2X or 4X Glyphosate (RoundUp ULTRA MAX™, available from Monsanto, St. Louise, Mo.) as per methods described in Example 17. Plants were scored after 10 days and leaf discoloration scores taken as described in Example 17. The T1 greenhouse spray data correlated well with previous greenhouse results at the T0 plant stage. T2 seed was collected for further studies.

Example 23

Production of Glyphosate and Sulfonamide Resistant Soybeans Expressing GAT and HRA Transgenes Soybean plants expressing GAT & HRA, high resistance allele of acetolactate synthase (U.S. Pat. Nos. 5,605,011, 5,378,824, 5,141,870, and 5013,659), genes were produced using the methods described in Example 17. The HRA gene was used as selectable marker gene for transformation. The selection agent was chlorsulfuron at a concentration of 100 ng/ml. The selectable marker gene was comprised of the S-adenosyl-L-methionine synthetase (SAMS) promoter from *Glycine max* U.S. 2003/226166), HRA coding sequence from *Glycine max* and acetolactate synthase terminator from *Glycine max*. The selectable marker gene was either linked to or co-bombarded with a GAT construct consisting of a synthetic constitutive promoter (U.S. Pat. Nos. 6,072,050 and 6,555,673) or the maize Histone 2B promoter (U.S. Pat. No. 6,177,611), a GAT variant (18-28D9c (SEQ ID NO:824)) and the Pin II terminator (Gyheung an et al., *Plant Cell* 1:115:122 (1989)). Transgenic plants were generated as described in Example 17. Levels of glyphosate resistance were determined as described in Example 17 using plant discoloration scores after 2X 4X glyphosate application rates. The results shown in Table 15 demonstrate that different constitutive promoters driving GAT variant (18-28D9c (SEQ ID NO:824)) confer glyphosate resistance in T0 plants.

TABLE 15

Resistance Scores at 10 days after treatment with 4X glyphosate.

| | # EVENTS TESTED WITH 4x | % EVENTS @ 7-8 SCORE | % EVENTS @ 3-6 SCORE |
|---|---|---|---|
| PHP20163a (SEQ ID NO: 824) (SCP1 PROMOTER) | 58 | 15.5% (9) | 77.6% (45) |
| PHP20558a (SEQ ID NO: 824) (H2B PROMOTER) | 26 | 34.6% (9) | 42.3% (11) |

Example 24

T1 Pre-Emergence Studies of Soybeans Expressing GAT and HRA Transgenes

T1 seed generated from experiments as described in Example 17, were planted in pots of Tama Silt loam in the greenhouse. Pots were immediately sprayed with a pre-emergence application of chlorimuron, rimsulfuron or tribenuron at a rate of 70 gms a.i./hectare. Germinating plants were evaluated 10 days post spray application based on plant discoloration scores described in Example 17. All HRA and GAT events survived all pre-emergence spray applications with a rating of 9 (uninjured). These results demonstrate pre-emergence resistance to sulfonamide chemistry in soybeans.

Example 25

T1 Post-Emergence Studies of Soybeans Expressing GAT and HRA Transgenes

T1 seed generated from experiments as described in Example 17 were germinated in RediEarth$^R$ 360 medium in the greenhouse. Plants were sprayed at the V2-V3 stage (14 days after potting) with thifensulfuron, chlorimuron, rimsulfuron or tribenuron (70, 70, 35, 35 gm a.i./hectare, respectively). Plants were evaluated 10 days post application based on plant discoloration scores described in Example 17. Results are shown in Table 16.

TABLE 16

Resistance Scores at 10 days after Post-Emergence treatment with Sulfonamide Chemistry.

| | Average Resistance scores from GAT (SEQ ID NO: 824)/SAMS promoter-HRA events |
|---|---|
| Unsprayed control | 9 |
| Chlorimuron (70 gm a.i./ha) | 7.75 |
| Rimsulfuron (35 gm a.i./ha) | 2.21 |
| Tribenuron (35 gm a.i./ha) | 3.83 |
| Thifensulfuron (70 gm a.i./ha) | 7.81 |

Events having a plant discoloration rating 7 or 8 after thifensulfuron spray were sprayed with either a 2× or 4× application of glyphosate after 10 days as per methods described in Example 17. Events were evaluated based on discoloration scores described in Example 17. All thifensulfuron tolerant events survived the glyphosate spray with score of 7 or 8 (results not shown). These results demonstrate 100% correlation of thifensulfuron tolerance with glyphosate tolerance under greenhouse conditions conferred by HRA and GAT genes, respectively, at 70 gm a.i./hectare thifensulfuron and 2X glyphosate, respectively.

Example 26

T3 Studies of Glyphosate-Resistant Maize Plants Expressing GAT Transgenes

Maize plants expressing GAT transgenes 20-H812 (SEQ ID NO:738) and 20-16A3 (SEQ ID NO:638) were produced using the methods described in Example 13. Plants were scored after 10 days and leaf discoloration scores taken as described in Example 13. Specifically, plants were sprayed at V4 leaf stage. The plants were thinned to equal spacing and stand counts after application of spray treatments. Commercially available NK603 (Monsanto, St. Louis, Mo.) was used as a control. Resistance scores are shown in Table 18. Plant height measurements were also taken 10 days after treatment and are shown in Table 18.

TABLE 18

Resistance Scores at 10 days after treatment with glyphosate
Resistance Scores (1-9 scale)

| CONSTRUCTS | # events tested | No Glyphosate Treatment Control | 1X (26 oz/A) UltraMax | 4X (104 oz/A) UltraMax | 8X (208 oz/A) UltraMax |
|---|---|---|---|---|---|
| 19900 (SEQ ID NO: 738) | 2 | 9 | 8.8 | 7.9 | 5.4 |
| 19902 (SEQ ID NO: 638) | 4 | 9 | 8.4 | 8.0 | 5.9 |
| NK603 | 1 | 9 | 8.4 | 7.9 | 5.5 |

TABLE 19

Plant Height (in inches) 10 days after treatment with glyphosate

| CONSTRUCTS | # events tested | No Glyphosate Treatment Control | 1X (26 oz/A) UltraMax | 4X (104 oz/A) UltraMax | 8X (208 oz/A) UltraMax |
|---|---|---|---|---|---|
| 19900 (SEQ ID NO: 738) | 2 | 18.5 | 16.6 | 16.4 | 16.2 |
| 19902 (SEQ ID NO: 638) | 4 | 19.5 | 16.7 | 17.0 | 16.2 |
| NK603 | 1 | 20.1 | 17.6 | 17.5 | 17.3 |

Example 27

T3 Yield Studies of Glyphosate-Resistant Maize Expressing GAT Transgenes

T3 seed from Example 15 was used to generate T3 plants for the generation of glyphosate field tolerance data on hybrids. The experiment was conducted at Viluco, Chile with four (4) replications using a split-plot design. Specifically, 3 entries were included. Two of the entries comprised maize plants expressing GAT variant transgenes 17-15H3 (SEQ ID NO:549). A glyphosate-resistant control NK603, which is commercially available from Monsanto, was the third entry. All entries were treated in the field with four different glyphosate spray treatments (0X, 4X at V4, 8X at V4, and 4X at V4 and 4X at V8) for each event. Plants were scored 10 days after treatment for plant height comparisons as described in Example 13. The T3 field spray data correlated well with the results previously obtained in the field as reported in Example 15. Specifically, all entries sprayed with 1X and 4X glyphosate were similar in height to unsprayed controls. At the higher 4X at V4 and 4X at V8 rates, the GAT entries were temporarily set back between 12 and 17% in height and the NK603 entry was set back 6%; however, later in the season (during reproductive maturity) the height of glyphosate-treated entries was the same as in the unsprayed entries. Moreover, yields among glyphosate-treated entries were neither numerically nor statistically reduced from unsprayed entries ($LSD_{0.05}$=11.8 bu./acre, average yield per entry=243 bu./acre). Similar results were observed in preliminary agronomic trials with T2 plants of the same events that were planted in Johnston, Iowa and York, Nebr. (data not shown).

Example 28

T2 Studies of Glyphosate-Resistant Maize Expressing GAT Transgenes

Experiments were conducted on GAT positive and GAT negative iso-lines. Maize plants expressing GAT transgenes 18-28D9b (SEQ ID NO:814), 17-15H3 (SEQ ID NO:549), 20-8H12 (SEQ ID NO:738), 20-16A3 (SEQ ID NO:638), were produced using the methods described in Example 17. T2 plants were examined. GAT positive T2 plants were sprayed at V4 with 1X (26 oz/A ULTRA MAX™). GAT negative plants were PCR sampled at V4. GAT positive plants were removed from the row. No glyphosate was applied to the GAT negative plants. Plants were thinned to create equal spacing among plants within each row. Four (4) replications were performed. Grain from five (5) ears harvested from the middle of each row was dried and weighed. As shown in Table 20 no yield reduction was detected for any of the constructs.

TABLE 20

Yield data.

| Construct | # of events | Yield GAT positive sprayed with 1X (26 oz/A) ULTRA MAX™ at V4 | YIELD GAT negative no glyphosate applied |
|---|---|---|---|
| PHP19286 (SEQ ID NO: 814) | 40 | 1.65 lbs/5 ears | 1.57 lbs/5 ears |
| PHP19288 (SEQ ID NO: 549) | 40 | 1.64 lbs/5 ears | 1.60 lbs/5 ears |
| PHP19900 (SEQ ID NO: 738) | 6 | 1.20 lbs/5 ears | 1.23 lbs/5 ears |
| PHP19902 (SEQ ID NO: 638) | 4 | 1.19 lbs/5 ears | 1.21 lbs/5 ears |

Example 29

Amino Acid Substrates of GAT Polypeptides

GAT activity of several GAT polypeptides of the present invention was evaluated with respect to a number of amino acid substrates. The GAT polypeptide, AcCoA and amino substrate were incubated in 25 mM Hepes, pH 6.8, 10% ethylene glycol in the wells of a 96-well polystyrene plate. After 30 minutes, the reactions were stopped by the addition of 30 µl of 10 mM 5,5'-dithiobis-2-nitrobenzoate (DTNB) in 500 mM Tris, pH 7.5. After 2 minutes, absorbance was read at 412 nm in a Spectramax Plus plate reader (Molecular Devices, Sunnyvale, Calif.).

In addition to glyphosate, native GAT polypeptide 401 (SEQ ID NO: 6) (or B6 (SEQ ID NO: 7), in the case of phosphoserine) exhibited detectable activity with 12 amino acids.

The native GAT polypeptide was about as active with L-aspartate, about 4.7 times more active with L-serine, and about 2 times more active with phospho-L-serine than with glyphosate. When compared to native GAT polypeptide, non-native GAT polypeptides 17-15H3 (SEQ ID NO: 601) and 25-8H7 (SEQ ID NO: 907) exhibited a 40-fold increase in activity with aspartate, but loss of activity with respect to serine and phosphoserine.

In addition to aspartate and serine, activity with native GAT polypeptide at 3% or more of that toward glyphosate when present at 1 mM was observed with the following L-amino acids: histidine (10%), tyrosine (18%), threonine (250%), valine (12%), glutamate (51%), asparagine (27%), glutamine (32%), alanine (33%), glycine (21%) and cysteine (50%). Activity with the other protein amino acids was either undetected or less than 3% that of GAT activity towards glyphosate as the substrate. No detectable activity was observed with respect to the native GAT polypeptide on the N-methyl derivatives of L-aspartate (2 mM), L-alanine (10 mM) and glycine (i.e., sarcosine, 10 mM). The percentages refer to percent activity relative to activity of the GAT polypeptide towards the substrate, glyphosate. Some of the data is shown below in Table 21.

TABLE 21

GAT activity with respect to Glyphosate, Aspartate and Serine

| GAT variant | Substrate | $k_{cat} \pm SE$, $min^{-1}$ | $K_M \pm SE$ MM | $k_{cat}/K_M$ $min^{-1} mM^{-1}$ | $k_{cat}/K_M$ |
|---|---|---|---|---|---|
| 401 | Glyph | 5.35 ± 0.043 | 1.27 ± 0.0144 | 4.21 | Fold imp. |
| 17-15H3 | | 1150 ± 27.6 | 0.251 ± 0.0041 | 4573 | 1086 |
| 25-8H7 | | 1480 ± 65.4 | 0.05 | 29600 | 7031 |
| | | | | | % of glyph |
| 401 | Aspartate | 24.1 | 6.7 | 3.6 | 85.5 |
| 17-15H3 | | 435 ± 11.3 | 2.95 ± 0.162 | 148 | 3.24 |
| 25-8H7 | | 702 ± 12.4 | 4.56 ± 0.112 | 154 | 0.520 |
| 401 | Serine | 854 | 43 | 19.8 | 471 |
| 17-15H3 | | 242 ± 15.8 | 60.1 ± 1.68 | 4.04 | 0.0882 |
| 25-8H7 | | 388 ± 18.5 | 154 ± 10.7 | 2.53 | 0.00855 |

Example 30

Effect of pH on GAT Activity

Figure 18:
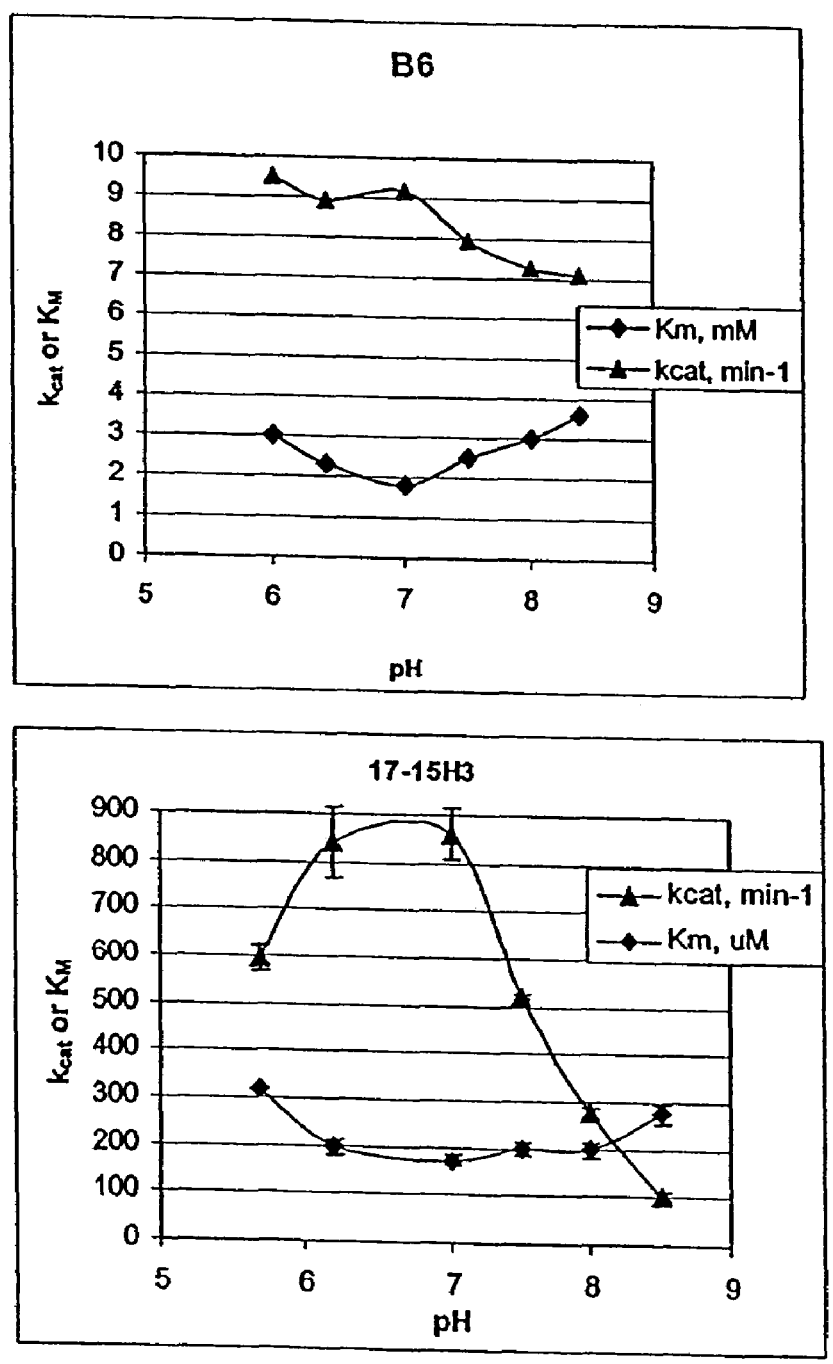
FIG. 18 depicts the effect of pH on $K_{cat}$ and $K_M$ as described in Example 30.

The pH optima of $k_{cat}$ and $K_M$ for wild-type enzyme B6 (SEQ ID NO: 7) and GAT polypeptide 17-15H3 (SEQ ID NO: 601) were determined using the spectrophotometric assay described in Example 7 except that assay buffer was 50 mM Hepes and 10% ethylene glycol, titrated to a range of pH values. Protein concentrations were determined by the UV absorbance assay described in Example 19. The effect of pH on $K_M$ and $K_{cat}$ is shown in FIG. 18 for clones B6 (SEQ ID NO: 7) and 17-15H3 (SEQ ID NO: 601).

While the foregoing invention has been described in some detail for purposes of clarity and understanding, it will be clear to one skilled in the art from a reading of this disclosure that various changes in form and detail can be made without departing from the true scope of the invention. For example, all the techniques, methods, compositions, apparatus and systems described above may be used in various combinations. The invention is intended to include all methods and reagents described herein, as well as all polynucleotides, polypeptides, cells, organisms, plants, crops, etc., that are the products of these novel methods and reagents.

All publications, patents, patent applications, or other documents cited in this application are incorporated by reference in their entirety for all purposes to the same extent as if each individual publication, patent, patent application, or other document were individually indicated to be incorporated by reference for all purposes.

SEQUENCE LISTING (972 sequences)

SEQ ID NO: 1 - DNA, 441 bp, Bacillus licheniformis
  ST401 gat
atgattgaagtcaaaccaataaacgcggaagatacgtatgagatcaggcaccgcattctccggccgaatcagccgcttgaagcatgtatgtatgaaaccgatttgctcgggggtgcgtttcacctcggtggatattaccggggcaagctgatcagcatcgcttcctttcataaagccgaacattcagagcttgaaggcgaagaacagtatcagctgagagggatggcgacgcttgaaggataccgtgagcaaaaagcgggaagcacgctcatccgccatgccgaagagcttcttcggaaaaagggggcagaccttttatggtgcaatgccaggacatctgtgagcggctactatgaaaagctcggcttcagcgaacagggcgaagtctacgacataccgccgatcggacctcatattttgatgtataagaaattgacgtaa

SEQ ID NO: 2 - DNA, 441 bp, Unknown
  Unidentified microorganism derived from soil sample.
  B6 gat
atgattgaagtcaaacctataaacgcggaagatacgtatgagatcaggcaccgcattctccggccgaatcagccgctggaagcatgcaagtatgaaaccgatttgctcgggggcacgtttcacctcggcggatattatcgggacaggctgatcagcatcgcctcctttcatcaagccgaacattcagagcttgaaggccaaaaacagtatcagctgagagggatggcgacacttgaagggtaccgcgagcaaaaagcgggcagtacgcttatccgccatgccgaagagcttcttcggaaaaaaggcgcagaccttttatggtgcaacgccaggacatctgtgagcgggtactataaaaagctcggcttcagcgaacaaggcggggtctacgatataccgccgatcggacctcatattttgatgtataagaaattgacataa

SEQ ID NO: 3 - DNA, 441 bp, Unknown
  Unidentified microorganism derived from soil sample.
  DS3
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcttcctttcataatgccgaacattcagagcttgaaggccaaaaacagtatcagctgagagggatggcgacgcttgaagggtaccgcgagcaaaaagcgggaagtacgcttatccgccatgccgaagagcttcttcgaaaaaaaggcgcggaccttttatggtgcaacgccaggatatctgtgagcggctactatgaaaagctcggcttcagcgaacaaggcgggatctacgacataccgccgatcggacctcatattttgatgtataagaaattggcataa

SEQ ID NO: 4 - DNA, 441 bp, Unknown
  Unidentified microorganism derived from soil sample.
  NHA-2
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcttcctttcataatgccgaacattcagagcttgaaggccaaaaacagtatcagctgagagggatggcgacgcttgaagggtaccgcgagcaaaaagcgggaagtacgcttatccgccatgccgaagagcttcttcgaaaaaaaggcgcggaccttttatggtgcaacgccaggatatctgtgagcggctactatgaaaagctcggcctcagcgaacaaggcgggatctacgacataccgccgatcggacctcatattttgatgtataagaaattggcataa

SEQ ID NO: 5 - DNA, 441 bp, Unknown
  Unidentified microorganism derived from soil sample.
  NH5-2
atgattgaagtcaaaccaataaacgcggaagatacgtatgagatcaggcaccgcattctccggccgaatcagccgcttgaagcatgtatgtatgaaaccgatttgctcgggggtgcgtttcacctcggtggatattaccagggcaagctgatcagcatcgcttcctttcataaagccgaacattcagagcttgagggcgaagaacagtatcagctgagagggatggcgacgcttgaaggataccgtgagcaaaaagcgggaagcacgctcatccgccatgccgaagagcttcttcggaaaaagggggcagaccttttatggtgcaatgccaggacatctgtgagcggctactatgaaaagctcggcttcagcgaacagggcgaagtctacgacataccgccgatcggacctcatattttgatgtataagaaattgacgtaa

SEQ ID NO: 6 - protein, 146 aa, Bacillus licheniformis
  ST401 GAT
MIEVKPINAEDTYEIRHRILRPNQPLEACMYETDLLGGAFHLGGYYRGKLISIASFHKAEHSELEGEEQYQLRGMATLEGYREQKAGSTLIRHAEELLRKKGADLLWCNARTSVSGYYEKLGFSEQGEVYDIPPIGPHILMYKKLT

SEQ ID NO: 7 - protein, 146 aa, Unknown
  Unidentified microorganism derived from soil sample.
  B6 GAT
MIEVKPINAEDTYEIRHRILRPNQPLEACKYETDLLGGTFHLGGYYRDRLISIASFHQAEHSELEGQKQYQLRGMATLEGYREQKAGSTLIRHAEELLRKKGADLLWCNARTSVSGYYKKLGFSEQGGVYDIPPIGPHILMYKKLT

SEQ ID NO: 8 - protein, 146 aa, Unknown
  Unidentified microorganism derived from soil sample.
  DS3 GAT
MIEVKPINAEDTYEIRHRILRPNQPLEACMYETDLLGGTFHLGGYYRGKLISIASFHNAEHSELEGQKQYQLRGMATLEGYREQKAGSTLIRHAEELLRKKGADLLWCNARISVSGYYEKLGFSEQGGIYDIPPIGPHILMYKKLA

SEQ ID NO: 9 - protein, 146 aa, Unknown
  Unidentified microorganism derived from soil sample.
  NHA-2 GAT
MIEVKPINAEDTYEIRHRILRPNQPLEACMYETDLLGGTFHLGGYYRGKLISIASFHNAEHSELEGQKQYQLRGMATLEGYREQKAGSTLIRHAEELLRKKGADLLWCNARISVSGYYEKLGLSEQGGIYDIPPIGPHILMYKKLA

SEQ ID NO: 10 - protein, 146 aa, Unknown
  Unidentified microorganism derived from soil sample.
  NH5-2 GAT
MIEVKPINAEDTYEIRHRILRPNQPLEACMYETDLLGGAFHLGGYYQGKLISIASFHKAEHSELEGEEQYQLRGMATLEGYREQKAGSTLIRHAEELLRKKGADLLWCNARTSVSGYYEKLGFSEQGEVYDIPPIGPHILMYKKLT

SEQ ID NO: 11 - DNA, 441 bp, Artificial Sequence
  Synthetic nucleic acid sequence
  13_10F6
atgattgaagtcaaaccaataaacgcggaagatacgtatgagatcaggcaccgcattctccggccgaatcagccgctggaagcatgcaagtatgaaaccgatttgctcaggggtacgtttcacctcggtggatattaccggggcaagctgatcagcatcgcctcctttcatcaagccgaacatccagagcttgaaggccaaaaacagtatcagctgagagggatggcgacactcgaaggataccgtgagcaaaaagcgggaagcacgctcatccgccatgccgaagagcttcttcggaaaaaaggcgcggaccttttatggtgcaacgccaggacgtctgcgagcgggtactataaaaagctcggcttcagcgaacagggcgaagtctacgacataccgccggtcggacctcatattttgatgtataagaaattgacgtaa

SEQ ID NO: 12 - DNA, 441 bp, Artificial Sequence
  Synthetic nucleic acid sequence
  13_12G6
atgattgaagtcaaaccaataaacgcggaagatacgtatgagatcaggcaccgcattctccggccgaatcagccgctggaagcatgcaagtatgaaaccgatttgctcaggggtgcgtttcacctcggtggatattaccggggcaagctggtcagcatcgcctcctttcatcaagccgaacatccagagcttgaaggccaaagacagtatcagctgagagggatggcgacacttgaagggtaccgtgagcaaaaagcgggcagtacgcttatccgccatgccgaagagcttcttcggaaaaagggggcagacctcttatggtgcaacgccaggacatctgcgagcgggtactataaaaagctcggcttcagcgaacagggcgaagtctacgacataccgccgactgggccccatattttgatgtataagaaattgacataa

SEQ ID NO: 13 - DNA, 441 bp, Artificial Sequence
  Synthetic nucleic acid sequence
  14_2A5
atgattgaagtcaaaccaataaacgcggaagatacgtatgagatcaggcaccgcattctccggccgaatcagccgctggaagcatgcaagtatgaaaccgatttgctcgggagcacgtttcacctcggtggatattaccggggcaagctgatcagcatcgcttcctttaatcaagccgaacatccagagcttgaaggccaaaaacagtatcagctgagagggatggcgacacttgaagggtaccgtgagcaaaaagcgggaagcacgcttatccgccatgccgaagagcttcttcggaaaaaaggcgcggaccttttatggtgcaacgccaggacgtctgcgagcgggtactataaaaagctcggcttcagcgaacagggcgaagtctacgacacaccgccggtcggacctcatattttgatgtataagaaattgacgtaa

SEQ ID NO: 14 - DNA, 441 bp, Artificial Sequence
  Synthetic nucleic acid sequence
  14_2C1
atgattgaagtcaaaccaataaacgcggaagatacgtatgagatcaggcaccgcattctccggccgaatcagccgctggaagcatgcaagtatgaaaccgatttgctcaggggtgcgtttcacctcggtggatattaccggggcaagctggtcagcatcgcttcctttcatcaagccgaacatccagagcttgaaggccaaaaacagtatcagctgagagggatggcgacactcgaaggataccgtgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacacaccgccgactgggccccatattttgatgtataagaaattgacgtaa

SEQ ID NO: 15 - DNA, 441 bp, Artificial Sequence
  Synthetic nucleic acid sequence
  14_2F11
atgattgaagtcaaaccaataaacgcggaagatacgtatgagatcaggcaccgcattctccggccgaatcagccgctggaagcatgcaagtatgaaaccgatttgctcaggggtgcgtttcaccttggtggatattaccggggcaagctggtcagcatcgcctcctttcatcaagccgaacatccagagcttgaaggccaaaaacagtatcagctgagagggatggcgacactcgaaggataccgtgagcaaaaagcgggcagtacgcttatccgccatgccgaagcgcttcttcggaaaaagggggcagacctcttatggtgcaacgccaggacatctgcgagcgggtactataaaaagctcggcttcagcgaacagggcgaagtctacgacacaccgccggccggaccccatattttgatgtataagaaattgacgtaa

SEQ ID NO: 16 - DNA, 441 bp, Artificial Sequence
  Synthetic nucleic acid sequence
  CHIMERA
atgattgaagtcaaaccaataaacgcggaagatacgtatgagatcaggcaccgcattctccggccgaatcagccgcttgaagcatgtatgtatgaaaccgatttgctcaggggtgcgtttcacctcggtggatattaccggggcaagctgatcagcatcgcttcctttcatcaagccgaacattcagagcttgaaggccaaaaacagtatcagctgagagggatggcgacacttgaaggataccgcgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 17 - DNA, 441 bp, Artificial Sequence
  Synthetic nucleic acid sequence
  10_12D7
  misc_feature 54: n = A,T,C or G
atgattgaagtcaaaccaataaacgcggaagatacgtatgagatcaggcaccgnattctccggccgaatcagccgctggaagcatgcaagtatgaaaccgatttgctcgggggcacgcttcacctcggtggatattaccggggcaagctgatcagcatcgcttcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacaaggcgaagtctacgacataccgccgaccggaccccatattttgatgtataagaaattgacgtaa

SEQ ID NO: 18 - DNA, 441 bp, Artificial Sequence
  Synthetic nucleic acid sequence
  10_15F4
atgattgaagtcaaaccaataaacgcggaagatacgtatgagatcaggcaccgcattctccggccgaatcagccgcttgaagcatgtatgtatgaaaccgatttgctcaggggtacgtttcacctcggtgggtattaccggggcaagctggtcagcatcgcttcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 19 - DNA, 441 bp, Artificial Sequence
  Synthetic nucleic acid sequence
  10_17D1
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaagggcgcagaccttttatggtgcaacgccaggacatctgcgagcgggtactataaaaagctcggcttcagcgaacaaggcgaagtctacgacacaccgccggtcggacctcatattttgatgtataagaaattgacgtaa

SEQ ID NO: 20 - DNA, 441 bp, Artificial Sequence
  Synthetic nucleic acid sequence
  10_17F6
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctggtcagcatcgcttcctttcatcaagccgaacattcagagcttgaaggccaaaaacagtatcagctgagagggatggcgacacttgaagagtaccgcgagcaaaaagcgggaagcacgcttatccgccatgccgaagagcttcttcggaaaaagggcgcagaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 21 - DNA, 441 bp, Artificial Sequence
  Synthetic nucleic acid sequence
  10_18G9
atgattgaagtcaaaccaataaacgcggaagatacgtatgagatcaggcaccgcattctccggccgaatcagccgctggaagcatgcaagtatgaaactgatttgctcggtggcacgtttcacctcggtggatattaccggggcaagctggtcagcatcgcttcctttcatcaagccgaacattcagagcttgaaggccaaaaacagtatcagctgagagggatggcgacacttgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 22 - DNA, 441 bp, Artificial Sequence
  Synthetic nucleic acid sequence
  10_1H3
atgattgaagtcaaaccaataaacgcggaggatacgtatgagatcaggcaccgcattctccggccgaatcagccgctggaagcatgcaagtatgaaaccgatttgctcgggggtacgtttcacctcggtggatattatcggggcaagctggtcagcatcgcttcctttcatcaagccgaacatccagagcttgaaggccgaaaacagtatcagctgagagggatggcgacacttgaagggtaccgcgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgccgaccggaccccatattttgatgtataagaaattgacataa

SEQ ID NO: 23 - DNA, 441 bp, Artificial Sequence
  Synthetic nucleic acid sequence
  10_20D10
atgattgaagtcaaaccaataaacgcggaagatacgtatgagatcaggcaccgcattctccggccgaatcagccgcttgaagcatgtatgtatgaaaccgatttgctcgggggcacgcttcacctcggtggatattaccggggcaagctgatcagcatcgcctcctttcatcaagccgaacatccagagcttgaaggccaaaaacagtatcagctgagagggatggcgacacttgaagagtaccgcgagcaaaaagcgggcagtacgcttatccgccatgccgaagagcttcttcggaaaaagggggcagaccttttatggtgcaacgccaggacatctgcgagcggctactataaaaagctcggcttcagcgaacaaggcggggtctacgacataccgccggtcggacctcatattttgatgtataagaaattgacgtaa

SEQ ID NO: 24 - DNA, 441 bp, Artificial Sequence
  Synthetic nucleic acid sequence
  10_23F2
atgattgaagtcaaaccaataaacgcggaagatacgtatgagatcaggcaccgcatactccggccgaatcagccgcttgaagcatgtatgtatgaaaccgatttgctcgggggcacgtttcacctcggtggatattaccggggcaagctggtcagcatcgcttcctttcatcaagccgaacacccagagcttgaaggccaaaaacagtatcagctgagagggatggcgacactcgaaggataccgtgagcaaaaagcgggcagtacgcttatccgccatgccgaagagcttcttcggaaaaagggggcagacctcttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 25 - DNA, 441 bp, Artificial Sequence
  Synthetic nucleic acid sequence
  10_2B8
atgattgaagtcaaaccaataaacgcggaagatacgtatgagatcaggcaccgcattctccggccgaatcagccgctggaagcatgcaagtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacacttgaagagtaccgcgagcaaaaagcgggcagtacgcttatccgccatgccgaagagcttcttcggaaaaagggggcagacctcttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 26 - DNA, 441 bp, Artificial Sequence
  Synthetic nucleic acid sequence
  10_2C7
atgattgaagtcaaaccaataaacgcggaagatacgtatgagatcaggcaccgcattctccggccgaatcagccgctggaagcatgcaagtatgaaaccgatttgctcaggggtgcgtttcacctcggcggatattaccggggcaagctgatcagcatcgcctcctttcatcaagccgaacatccagagcttgaaggccaaaaacagtatcagctgagagggatggcgacactcgaagggtaccgtgagcaaaaagcgggaagcacgctcatccgccatgccgaagagcttcttcggaaaaaaggcgcggaccttttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 27 - DNA, 441 bp, Artificial Sequence
  Synthetic nucleic acid sequence
  10_3G5
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctggtcagcatcgcttcctttcatcaagccgaacatccagagcttgaaggccaaaaacagtatcagctgagagggatggcgacacttgaagggtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccgaccggaccccatattttgatgtataagaaattgacgtaa

SEQ ID NO: 28 - DNA, 441 bp, Artificial Sequence
  Synthetic nucleic acid sequence
  10_4H7
atgattgaagtcaaaccgataaacgcggaagatacgtatgagatcaggcaccgcattctccggccgaatcagccgcttgaagcatgtatgtatgaaaccgatttgctcgggggcacgtttcacctcggtggatattaccggggcaagctggtcagcatcgcttcctttcatcaagccgaacatccagagcttgaaggccaaaaacagtatcagctgagagggatggcgacacttgaagggtaccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccgaccggaccccatattttgatgtataagaaattgacgtaa

SEQ ID NO: 29 - DNA, 441 bp, Artificial Sequence
  Synthetic nucleic acid sequence
  10_6D11
atgattgaagtcaaaccaataaacgcggaagatacgtatgagatcaggcaccgcattctccggccgaatcagccgctggaagcatgcaagtatgaaaccgatttgctcgggggcacgcttcacctcggtggatattaccggggcaagctggtcagcatcgcttcctttcatcaagccgaacatccagagcttgaaggccaaaaacagtatcagctgagagggatggcgacgcttgaagggtaccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 30 - DNA, 441 bp, Artificial Sequence
  Synthetic nucleic acid sequence
  10_8C6
atgattgaagtcaaaccaataaacgcggaagatacgtatgagatcaggcaccgcattctccggccgaatcagccgctggaagcatgcaagtatgaaaccgatttgctcgggggtgcgtttcacctcggtggatattaccggggcaagctgatcagcatcgcctcctttcatcaagccgaacatccagagcttgaaggccaaaaacagtatcagctgagagggatggcgacactcgaaggataccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 31 - DNA, 441 bp, Artificial Sequence
  Synthetic nucleic acid sequence
  11C3
atgattgaagtcaaaccaataaacgcggaagatacgtatgagatcaggcaccgcattctccggccgaatcagccgcttgaagcatgcaagtatgaaaccgatttgctcgggggtacgtttcacctcggtggatattaccagggcaagctgatcagcatcgcctcctttcatcaagccgaacattcagagcttgaaggccaaaaacagtatcagctgagagggatggcgacgcttgaagggtaccgcgagcaaaaagcgggaagtacgcttatccgccatgccgaagagcttcttcggaaaaagggggcagaccttttatggtgcaacgccaggacatctgtgagcgggtactataaaaagctcggcttcagcgaacaaggcggggtctacgatataccgccgatcggacctcatattttgatgtataagaaattgacataa

SEQ ID NO: 32 - DNA, 441 bp, Artificial Sequence
  Synthetic nucleic acid sequence
  11G3
atgattgaagtcaaaccaataaacgcggaagatacgtatgagatcaggcaccgcattctccggccgaatcagccgcttgaagcgtgtatgtatgaaaccgatttgctcgggggcacgtttcacctcggcggatattaccagggcaagctgatcagcatcgcttcctttcatcaagccgaacattcagagcttgaaggccaaaaacagtatcagctgagagggatggcgacgcttgaagggtaccgcgagcaaaaagcgggcagtacgcttatccgccatgccgaagagcttcttcggaaaaagggggcagaccttttatggtgcaacgccaggacatctgcgagcggctactatgaaaagctcggcttcagcgaacaaggcggggtctacgatataccgccgatcggacctcatattttgatgtataagaaattggcataa

SEQ ID NO: 33 - DNA, 441 bp, Artificial Sequence
  Synthetic nucleic acid sequence
  11H3
atgattgaagtcaaaccaataaacgcggaagatacgtatgagatcaggcaccgcatactccggccgaatcagccgctggaagcatgcaagtatgaaaccgatttgctcaggggtgcgtttcacctcggtggatattaccggggcaagctgatcagcatcgcctcctttcatcaagccgaacacccagagcttgaaggccaaaaacagtatcagctgagagggatggcgacacttgaagggtaccgtgagcaaaaagcgggcagtacgcttatccgccatgccgaagcgcttcttcggaaaaaaggcgcggaccttttatggtgcaacgccaggacatctgcgagcgggtactataaaaagctcggcttcagcgaacagggcgaagtctacgacataccgccaactgggccccatattttgatgtataagaaattgacgtaa

SEQ ID NO: 34 - DNA, 441 bp, Artificial Sequence
  Synthetic nucleic acid sequence
  12_1F9
atgattgaagtcaaaccaataaacgcggaagatacgtatgagatcaggcaccgcatactccggccgaatcagccgctggaagcatgcaagtatgaaaccgatttgctcgggggcacgtttcacctcggtggatattaccggggcaagctgatcagcatcgcctcctttcatcaagccgaacatccagagcttgaaggccaaaaacagtatcagctgagagggatggcgacacttgaagggtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacagggcgaagtccacgacataccgccgaccggaccccatattttgatgtataagaaattgacgtaa

SEQ ID NO: 35 - DNA, 441 bp, Artificial Sequence
  Synthetic nucleic acid sequence
  12_2G9
atgattgaagtcaaaccaataaacgcggaagatacgtatgagatcaggcaccgcattctccggccgaatcagccgctggaagcatgcaagtatgaaaccgatttgctcgggggtacgtttcacctcggcggatattaccggggcaagctggtcagcatcgcttcctttcatcaagccgaacatccagagcttgaaggccaaaaacagtatcagctgagagggatggcgacacttgaaggataccgtgagcaaaaagcgggcagtacgcttatccgccatgccgaagagcttcttcggaaaaagggggcagacctcttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 36 - DNA, 441 bp, Artificial Sequence
  Synthetic nucleic acid sequence
  12_3F1
atgattgaagtcaaaccaataaacgcggaagatacgtatgagatcaggcaccgcattctccggccgaatcagccgctggaagcatgcaagtatgaaaccgatttgcttgggggcacgtttcacctcggtggatattaccggggcaagctgatcagcatcgcttcctttcatcaagccgaacatccagagcttgaaggccaaaaacagtatcagctgagagggatggcgacactcgaaggataccgtgagcaaaaagcgggaagtacgctcatccgccatgccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 37 - DNA, 441 bp, Artificial Sequence
  Synthetic nucleic acid sequence
  12_5C10
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattatcggggcaagctgatcagcatcgcttcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacagggcgaagtctacgacgcaccgccgaccggacctcatattttgatgtataagaaattgacgtaa

SEQ ID NO: 38 - DNA, 441 bp, Artificial Sequence
  Synthetic nucleic acid sequence
  12_6A10
atgattgaagtcaaaccaataaacgcggaagatacgtatgagatcaggcaccgcattctccggccgaatcagccgctggaagcatgcaagtatgaaaccgatttgctcgggggcacgtttcacctcggcggatattaccggggcaagctggtcagcatcgcctcctttcatcaagccgaacatccagagcttgaaggccaaaaacagtatcagctgagagggatggcgacacttgaaggataccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 39 - DNA, 441 bp, Artificial Sequence
  Synthetic nucleic acid sequence
  12_6D1
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacaaggcggggtctacgacataccgcctgtcggacctcatattttgatgtataagaaattgacgtaa

SEQ ID NO: 40 - DNA, 441 bp, Artificial Sequence
  Synthetic nucleic acid sequence
  12_6F9
atgattgaagtcaaaccaataaacgcggaagatacgtatgagatcaggcaccgcattctccggccgaatcagccgcttgaagcatgtaagtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacactcgaaggataccgcgagcaaaaagcgggaagcacgctcatccgccatgccgaagagcttcttcggaaaaagggggcagaccttttatggtgcaacgccaggacatctgcgagcggctactataaaaagctcggcttcagcgaacagggcgaagtctacgacataccgccgaccggaccccatattttgatgtataagaaattgacgtaa

SEQ ID NO: 41 - DNA, 441 bp, Artificial Sequence
  Synthetic nucleic acid sequence
  12_6H6
atgattgaagtcaaaccaataaacgcggaagatacgtatgagatcaggcaccgcatactccggccgaatcagccgctggaagcatgcaagtatgaaaccgatttgctcgggggcacgtttcacctcggtggatattaccggggcaagctggtcagcatcgcctcctttcaccaagccgaacatccagagcttgaaggccaaaaacagtatcagctgagagggatggcgacacttgaagggtaccgtgagcaaaaagcgggcagtacgcttatccgccatgccgaagcgcttcttcggaaaaaaggcgcggaccttttatggtgcaacgccaggacatctgcgagcgggtactataaaaagctcggcttcagcgaacagggcgaagtctacgacataccgccgaccggaccccatattttgatgtataagaaattgacataa

SEQ ID NO: 42 - DNA, 441 bp, Artificial Sequence
  Synthetic nucleic acid sequence
  12_7D6
atgattgaagtcaaaccaataaacgcggaagatacgtatgagatcaggcaccgcattctccggccgaatcagccgctggaagcatgcaagtatgaaactgatttgctcgggggcacgtttcacctcggtggatattaccggggcaagctgatcagcatcgcttcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaagggggcagaccttttatggtgcaacgccaggacatctgcgagcgggtactataaaaagctcggcttcagcgaacaaggcggggtctacgacataccgccgaccggaccccatattttgatgtataagaaattgacgtaa

SEQ ID NO: 43 - DNA, 441 bp, Artificial Sequence
  Synthetic nucleic acid sequence
  12_7G11
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaaggataccgcgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 44 - DNA, 441 bp, Artificial Sequence
  Synthetic nucleic acid sequence
  12F5
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccagggcaagctgatcagcatcgcttcctttcataaagccgaacattcagagcttgagggccaaaaacagtatcagctgagagggatggcgacacttgaagggtaccgcgagcaaaaagcgggcagtacgcttatccgccatgccgaagagcttcttcggaaaaagggggcagaccttttatggtgcaatgccaggacatctgtgagcgggtactataaaaagctcggcttcagcgaacaaggcgggatctacgacataccgccgatcggacctcatattttgatgtataagaaattgacgtaa

SEQ ID NO: 45 - DNA, 441 bp, Artificial Sequence
  Synthetic nucleic acid sequence
  12G7
atgattgaagtcaaaccaataaacgcggaagatacgtatgagatcaggcaccgcattctccggccgaatcagccgcttgaagcatgcaagtatgaaaccgatttgctcgggggtacgtttcacctcggtggatattaccagggcaagctgatcagcatcgcttcctttcataaagccgaacattcagagcttgaaggccaaaaacagtatcagctgagagggatggcgacgcttgaaggataccgtgagcaaaaagcgggaagcacactcatccgccatgccgaagagcttcttcggaaaaaaggcgcagaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 46 - DNA, 441 bp, Artificial Sequence
  Synthetic nucleic acid sequence
  1_2H6
atgattgaagtcaaaccaataaacgcggaagatacgtatgagatcaggcaccgcattctccggccgaatcagccgctggaagcatgtatgtatgaaaccgatttgctcgggggtgcgtttcacctcggtggatattaccggggcaagctgatcagcatcgcctcctttcatcaagccgaacattcagagcttgaaggccaaaaacagtatcagctgagagggatggcgacacttgaagggtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacaaggcggggtctacgacataccgccgatcggacctcatattttgatgtataagaaattgacgtaa

SEQ ID NO: 47 - DNA, 441 bp, Artificial Sequence
  Synthetic nucleic acid sequence
  13_12G12
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcttcctttaatcaagccgaacatccagagcttgaaggccaaaaacagtatcagctgagagggatggcgacacttgaagagtaccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgccggtcggacctcatattttgatgcataagaaattgacgtaa

SEQ ID NO: 48 - DNA, 441 bp, Artificial Sequence
  Synthetic nucleic acid sequence
  13_6D10
atgattgaagtcaaaccaataaacgcggaagatacgtatgagatcaggcaccgcattctccggccgaatcagccgcttgaagcatgtatgtatgaaaccgattcgctcggaggcacgtttcacctcggtggatattaccggggcaagctgatcagcatcgcttcctttaatcaagccgaacatccagagcttgaaggccaaaaacagtatcagctgagagggatggcgacactcgaagggtaccgtgagcaaaaagcgggaagcacgctcatccgccatgccgaagagcttcttcggaaaaagggggcagacctcttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 49 - DNA, 441 bp, Artificial Sequence
  Synthetic nucleic acid sequence
  13_7A7
atgatcgaagtcaaaccaataaacgcggaagatacgtatgagatcaggcaccgcattctccggccgaatcagccgcttgaagcatgtatgtatgaaaccgatttgctcaggagtgcgtttcacctcggcggatattaccggggcaagctgatcagcatcgcctcctttcaccaagccgaacatccagagcttgaaggccaaaaacagtatcagctgagggggatggcgacacttgaagagtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 50 - DNA, 441 bp, Artificial Sequence
  Synthetic nucleic acid sequence
  13_7B12
atgattgaagtcaaaccaataaacgcggaagatacgtatgagatcaggcaccgcattctccggccgaatcagccgctggaagcatgcaagtatgaaaccgatttgctcgggagcacgtttcacctcggtggatattaccggggcaagctgatcagcatcgcctcctttcatcaagccgaacatccagagcttgaaggccaaaaacagtatcagctgagagggatggcgacactcgaaggataccgcgagcaaaaagcgggcagtacgcttatccgccatgccgaagagcttcttcggaaaaaaggcgcggaccttttgtggtgcaacgccaggacatctgcgagcgggtactataaaaagctcggcttcagcgaacagggcgaagtctacgacataccgccgactgggccccatattttgatgtataagaagttgacgtaa

SEQ ID NO: 51 - DNA, 441 bp, Artificial Sequence
  Synthetic nucleic acid sequence
  13_7C1
atgattgaagtcaaaccaataaatgcggaagatacgtatgagatcaggcaccgcatactccggccgaatcagccgcttgaagcatgcaagtatgaaaccgatttgctcaggggtgcgtttcacctcggtggatattaccggggcaagctgatcagcatcgcctcctttcatcaagccgaacatccagaacttgaaggccaaaaacagtatcagctgagagggatggcgacacttgaaggataccgtgagcaaaaagcgggtagtacgcttatccgccatgccgaagagcttcttcggaaaaaaggcgcggaccttttgtggtgcaacgccaggacatctgcgagagggtactataaaaagctcggcttcagcgaacaaggcgaagtctacgacataccgccgactgggccccatattttgatgtataagaaattgacgtaa

SEQ ID NO: 52 - DNA, 441 bp, Artificial Sequence
  Synthetic nucleic acid sequence
  13_8G6
atgattgaagtcaaaccaataaacgcggaagatacgtatgagatcaggcaccgcattctccggccgaatcagccgctggaagcatgcaagtatgaaaccgattcgctcgggggcacgtttcacctcggcggatattaccggggcaagctgatcagcatcgcttcctttaatcaagccgaacatccagagcttgaaggtcaaaaacagtatcagctgagagggatggcgacacttgaaggataccgtgagcaaaaagcgggcagtacgcttatccgccatgccgaagagcttcttcggaaaaaaggcgcggaccttttatggtgcaacgccaggacgtctgcgagcgggtactataaaaagctcggcttcagcgaacaaggcggggtctacgacataccgccggtcggacctcatattttgatgtataagaaattgacgtaa

SEQ ID NO: 53 - DNA, 441 bp, Artificial Sequence
  Synthetic nucleic acid sequence
  13_9F6
atgattgaagtcaaaccaataaacgcggaagatacgtatgagatcaggcaccgcattctccggccgaatcagccgctggaagcatgcaagtatgaaaccgatctgcttgggggcacgtttcacctaggtggatattaccggggcaagctgatcagcatcgcctcctttcatcaagccgaacatccagagcttgaaggccaaaaacagtatcagctgagagggatggcgacacttgaagagtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 54 - DNA, 441 bp, Artificial Sequence
  Synthetic nucleic acid sequence
  14_10C9
atgattgaagtcaaaccaataaacgcggaagatacgtatgagatcaggcaccgcatactccggccgaatcagccgctagaagcatgcaagtatgaaaccgatttgctcaggggtgcgtttcacctcggtggatattaccggggcaagctgatcagcatcgcttcctttcatcaagctgaacatccagagcttgaaggccaaaaacagtatcagctgagagggatggcgacacttgaagagtaccgcgagcaaaaagcgggaagtacgctcatccgccatgccgaagagcttcttcggaaaaagggggcagaccttttatggtgcaacgccaggacgtctgcgagcgggtactataaaaagctcggcttcagcgaacagggcgaagtctacgacacaccgccggtcggacctcatattttgatgtataagaagttgacgtaa

SEQ ID NO: 55 - DNA, 441 bp, Artificial Sequence
  Synthetic nucleic acid sequence
  14_10H3
atgattgaagtcaaaccaataaacgcggaagatacgtatgagatcaggcaccgcattctccggccgaatcagccgctggaagcatgcaagtatgaaaccgatttgctcaggggtgcgtttcacctcggcggatattaccggggcaagctggtcagcatcgcctcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaaaggcgcagaccttttatggtgcaacgccaggacatctgcgagcgggtactataaaaagctcggcttcagcgaacagggcgaagtctacgacacaccgccggtcggacctcatattttgatgtataagaagttgacgtaa

SEQ ID NO: 56 - DNA, 441 bp, Artificial Sequence
  Synthetic nucleic acid sequence
  14_10H9
atgattgaagtcaaaccaataaacgcggaagatacgtatgagatcaggcaccgcatactccggccgaatcagccgctggaagcatgcaagtatgaaaccgatttgctcaggggtgcgtttcacctcggtggatattaccggggcaagctggtcagcatcgcctcctttcatcaagccgaacatccagagcttgaaggccaaaaacagtatcagctgagagggatggcgacacttgaaggataccgtgagcaaaaagcgggcagtacgcttatccgccatgccgaagagcttcttcggaaaaaaggcgcggaccttttgtggtgcaacgccaggacatctgcgagcgggtactataaaaagctcggcttcagcgaacagggcgaagtctacgacacaccgccggtcggacctcatattttgatgtataagaaattgacataa

SEQ ID NO: 57 - DNA, 441 bp, Artificial Sequence
  Synthetic nucleic acid sequence
  14_11C2
atgattgaagtcaaaccaataaacgcggaagatacgtatgagatcaggcaccgcattctccggccgaatcagccgctggaagcatgcaagtatgaaaccgatttgctcgggagcacgtttcacctcggcggatattaccggggcaagctggtcagcatcgcttcctttcatcaagccgaacatccagagcttgaaggccaaaaacagtatcagctgagagggatggcgacacttgaagagtaccgcgagcaaaaagcgggcagtacgcttatccgccatgccgaagcgcttcttcggaaaaagggggcagaccttttatggtgcaacgccaggacatctgcgagcgggtactataaaaagctcggcttcagcgaacagggcgaagtctacgacacaccgccgaccggaccccatattttgatgtataagaaattgacgtaa

SEQ ID NO: 58 - DNA, 441 bp, Artificial Sequence
  Synthetic nucleic acid sequence
  14_12D8
atgattgaagtcaaaccaataaacgcggaagatacgtatgagatcaggcaccgcattctccggccgaatcagccgcttgaagcatgtaagtatgaaaccgatttgctcgggggtacgtttcacctcggcggatattaccggggcaagctggtcagcatcgcctcctttcatcaagccgaacatccagagcttgaaggccaaaaacagtatcagctgagagggatggcgacacttgaaggataccgtgagcaaaaagctggcagtacgcttatccgccatgccgaagcgcttcttcggaaaaaaggcgcggaccttttgtggtgcaacgccaggacatctgcgagcggctactataaaaagctcggcttcagggaacaaggcggggtctacgacataccgcctgtcggacctcatattttgatgtataagaaattgacgtaa

SEQ ID NO: 59 - DNA, 441 bp, Artificial Sequence
  Synthetic nucleic acid sequence
  14_12H6
atgattgaagtcaaaccaataaacgcggaagatacgtatgagatcaggcaccgcattctccggccgaatcagccgctggaagcatgcaagtatgaaaccgatttgctcgggggtgcgtttcacctcggtggatattaccggggcaagctgatcagcatcgcctcctttcatcaagccgaacatccagagcttgaaggccaaaaacagtatcagctgagagggatggcgacacttgaagagtaccgcgagcaaaaagcgggcagtacgcttatccgccatgccgaagagcttcttcggaaaaaaggcgcggaccttttgtggtgcaacgccaggacgtctgcgagcgggtactataaaaagctcggcttcagcgaacagggcgaagtctacgacataccgccgactgggccccatattttgatgtataagaaattgacgtaa

SEQ ID NO: 60 - DNA, 441 bp, Artificial Sequence
  Synthetic nucleic acid sequence
  14_2B6
atgattgaagtcaaaccaataaatgcggaagatacgtatgagatcaggcaccgcattctccggccgaatcagccgctggaagcatgcaagtatgaaaccgatttgctcgggggtacgtttcacctcggtggatattaccggggcaagctgatcagcatcgcttcctttaatcaagccgaacatccagagcttgaaggccaaaaacagtatcagctgagagggatggcgacactcgaaggataccgtgagcaaaaagcgggcagtacgcttatccgccatgccgaagagcttcttcggaaaaaaggcgcggaccttttatggtgcaacgccaggacgtctgcgagcgggtactataaaaagctcggcttcagcgaacaaggcggggtctacgacataccgccggtcggacctcatattttgatgtataagaaattgacgtaa

SEQ ID NO: 61 - DNA, 441 bp, Artificial Sequence
  Synthetic nucleic acid sequence
  14_2G11
atgattgaagtcaaaccaataaatgcggaagatacgtatgagatcaggcaccgcattctccggccgaatcagccgctggaagcatgcaagtatgaaaccgatttgctcaggggtgcgtttcacctcggtggatattaccggggcaagctggtcagcatcgcctcctttcatcaagccgaacatccagagcttgaaggccaaaaacagtatcagctgagagggatggcgacactcgaagggtaccgtgagcaaaaagcgggcagtacgcttatccgccatgccgaagagcttcttcggaaaaaaggcgcggaccttttgtggtgcaacgccaggacatctgcgagtgggtactataaaaagctcggcttcagcgaacagggcgaagtctacgacataccgccgactgggccccatattttgatgtataagaaattgacgtaa

SEQ ID NO: 62 - DNA, 441 bp, Artificial Sequence
  Synthetic nucleic acid sequence
  14_3B2
atgattgaagtcaaaccaataaacgcggaagatacgtatgagatcaggcaccgcattctcaggccgaatcagccgctggaagcatgcaagtatgaaaccgatttgctcaggggtgcgtttcacctcggtggatattaccggggcaagctggtcagcatcgcctcctttcatcaggccgaacatccagagcttgaaggccaaaaacagtatcagctgagagggatggcgacacttgaaggataccgtgagcaaaaagcgggaagcacgcttatccgccatgccgaagcgcttcttcggaaaaaaggcgcggaccttttatggtgcaacgccaggacatctgcgagcgggtactataaaaagctcggcttcagcgaacaaggcggggtctacgacataccgccggccggacctcatattttgatgtataagaaattgacgtaa

SEQ ID NO: 63 - DNA, 441 bp, Artificial Sequence
  Synthetic nucleic acid sequence
  14_4H8
atgattgaagtcaaaccaataaacgcggaagatacgtatgagatcaggcaccgcattctccggccgaatcagccgctggaagcatgcaagtatgaaaccgatttgctcgggagcacgtttcacctcggcggatattaccggggcaagctgatcagcatcgcctcctttcatcaagccgaacatccagagcttgaaggccaaaaacagtatcagctgagagggatggcgacactcgaagggtaccgtgagcaaaaagcgggaagcacgctcatccgccatgccgaagagcttcttcggaaaaaaggcgcggaccttttgtggtgcaacgccaggacgtctgcgagcggctactataaaaagctcggcttcagcgaacagggcgaagtctacgacacaccgccggtcggacctcatattttgatgtataagaaattgacgtaa

SEQ ID NO: 64 - DNA, 441 bp, Artificial Sequence
  Synthetic nucleic acid sequence
  14_6A8
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctagtcagcatcgcttcctttaatcaagccgaacatccagagcttgaaggccaaaaacagtatcagctgagagggatggcgacacttgaaggataccgtgagcaaaaagcgggcagtacgcttatccgccatgccgaagagcttcttcggaaaaaaggcgcggaccttttgtggtgcaacgccaggacatctgcgagcgggtactataaaaagctcggcttcagcgaacagggcgaagtctacgacacaccgccggtcggacctcatgttttgatgtataagaaattgacgtaa

SEQ ID NO: 65 - DNA, 441 bp, Artificial Sequence
  Synthetic nucleic acid sequence
  14_6B10
atgattgaagtcaaaccaataaacgcggaagatacgtatgagatcaggcaccgcattctccggccgaatcagccgctggaagcatgcaagtatgaaaccgatttgctcgggggtacgtttcaccttggtggatattaccggggcaagctgatcagcatcgcttcctttcatcaagccgaacatccagagcttgaaggccaaaaacagtatcagctgagagggatggcgacactcgaaggataccgtgagcaaaaagcgggcagtacgcttatccgccatgccgaagagcttcttcggaaaaaaggcgcggaccttttatggtgcaacgccaggacatctgcgagcgggtactataaaaagctcggcttcagcgaacaaggcggggtctacgacatgccgccggtcggacctcatattttgatgtataagaagttgacgtaa

SEQ ID NO: 66 - DNA, 441 bp, Artificial Sequence
  Synthetic nucleic acid sequence
  14_6D4
atgattgaagtcaaaccaataaacgcggaagatacgtatgagatcaggcaccgcattctccgaccgaatcagccgctggaagcatgcaagtatgaaaccgatttgctcggaggcacgtttcacctcggtggatattaccggggcaagctgatcagcatcgcttcctttaatcaagccgaacatccagagcttgaaggccaaaaacagtatcagctgagagggatggcgacacttgaaggataccgtgagcaaaaagcgggcagtacgcttatccgccatgccgaagcgcttcttcggaaaaagggggcagacctcttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 67 - DNA, 441 bp, Artificial Sequence
  Synthetic nucleic acid sequence
  14_7A11
atgattgaagtcaaaccaataaacgcggaggatacgtatgagatcaggcaccgcattctccggccgaatcagccgctggaagcatgcaagtatgaaaccgatttgctcaggggtgcgtttcacctcggtggatattaccggggcaagctggtcagcatcgcctcctttcatcaagccgaacatccagagcttgaaggcctaaaacagtatcagctgagagggatggcgacactcgaagggtaccgtgagcaaaaagcgggaagtacgctcatccgccatgccgaagagcttcttcggaaaaagggggcagacctcttatggtgcaacgccaggacgtctgcgagcgggtactataaaaagctcggcttcagcgaacagggcgaagtctacgacacaccgccgaccggacctcatattttgatgtataagaaattgacgtaa

SEQ ID NO: 68 - DNA, 441 bp, Artificial Sequence; identical to SEQ ID NO: 67
  Synthetic nucleic acid sequence
  14_7A1

SEQ ID NO: 69 - DNA, 441 bp, Artificial Sequence
  Synthetic nucleic acid sequence
  14_7A9
atgattgaagtcaaaccaataaacgcggaggatacgtatgagatcaggcaccgcattctccggccgaatcagccgctggaagcatgcaagtatgaaaccgatttgctcgggggtacgtttcacctcggcggatattaccggggcaagttggtcagcatcgcctcctttcatcaagccaaacatccagagcttgaaggccaaaaacagtatcagctgagagggatggcgacactcgaagggtaccgtgagcaaaaagcgggtagtacgcttatccgccatgccgaagagcttcttcggaaaaaaggcgcggaccttttatggtgcaacgccaggacgtctgcgagcgggtactataaaaagctcggcttcagcgaacagggcgaagtctacgacacaccgccggtcggacctcatattttgatgtataagaaattgacgtaa

SEQ ID NO: 70 - DNA, 441 bp, Artificial Sequence
  Synthetic nucleic acid sequence
  14_7G1
atgattgaagtcaaaccaataaacgcagaagatacgtatgagatcaggcaccgcattctccggccgaatcagccgctggaagcatgcaagtatgaaaccgatttgctcaggggtgcgtttcacctcggtggatattaccggggcaagctgatcagcatcgcttcctttaatcaagccgaacatccagagcttgaaggccaaaaacagtatcagttgagagggatggcgacacttgaagagtaccgtgagcaaaaagcgggaagtacgcttatccgccatgccgaagcgcttcttcggaaaaagggggcagacctcttatggtgcaacgccaggacatctgcgagcgggtactataaaaagctcggcttcagcgaacagggcgaagtctacgacacaccgccggtcggacctcatattttgatgtataagaaattgacgtaa

SEQ ID NO: 71 - DNA, 441 bp, Artificial Sequence
  Synthetic nucleic acid sequence
  14_7H9
atgattgaagtcaaaccaataaacgcggaagatacgtatgagatcaggcaccgcattctccggccgaatcagccgctggaagcatgcaagtatgaaaccgatttgctcgggggtacgtttcacctcggcggatattaccggggcaagctggtcagcatcgcttcctttcatcaagccgaacatccagagcttgaaggccaaaaacagtatcagctgagagggatggcgacacttgaaggataccgtgagcaaaaagcgggaagcacgctcatccgccatgccgaagagcttcttcggaaaaaaggcgcggaccttttgtggtgcaacgccaggacatctgcgagcgggtactataaaaagctcggcttcagcgaacagggcgaagtctacgacataccgccggtcggacctcatattttgatgtataagaaattgacgtaa

SEQ ID NO: 72 - DNA, 441 bp, Artificial Sequence
  Synthetic nucleic acid sequence
  14_8F7
atgattgaagtcaaaccaataaacgcggaagatacgtatgagatcaggcaccgcattctccggccgaatcagccgcttgaagcatgcaagtatgaaaccgatttgctcgggggtacgtttcacctcggcggatattaccggggcaagctggtcagcatcgcctcctttcatcaagccgaacatccagagcttgaaggccaaaaacagtatcagctgagagggatggcgacacttgaagagtaccgcgagcaaaaagcgggcagtacgcttatccgccatgctgaagcgcttcttcggaaaaaaggcgcggaccttttgtggtgcaacgccaggacatctgcaagcgggtactataaaaagctcggcttcagcgaacagggcgaagtctacgacataccgccgactgggccccatattttgatgtataagaaattgacgtaa

SEQ ID NO: 73 - DNA, 441 bp, Artificial Sequence
  Synthetic nucleic acid sequence
  15_10C2
atgattgaagtcaaaccaataaacgcggaagatacgtatgagatcaggcaccgcattctccggccgaatcagccgctggaagcatgcaagtatgaaaccgatttgctcaggggtgcgtttcacctcggtggatattaccggggcaagctggtcagcatcgcctcctttcatcaagccgaacatccagagcttgaaggccaaaaacagtatcagctgagagggatggcgacacttgaaggataccgtgagcaaaaagcgggaagtacgctcatccgccatgccgaagagcttcttcggaaaaagggggcagacctcttatggtgcaacgccaggacaactgcgagcgggtactataaaaagctcggcttcagcgaacagggtgaagtcttcgacataccgccgaccggaccccatattttgatgtataagaaattgacgtaa

SEQ ID NO: 74 - DNA, 441 bp, Artificial Sequence
  Synthetic nucleic acid sequence
  15_10D6
atgattgaagtcaaaccaataaacgcggaagatacgtatgagatcaggcaccgcattctccggccgaatcagccgcttgaagcatgtatgtatgaaaccgatttgctcgggggcacgtttcacctaggtggatattaccggggcaagctggtcagcatcgcctcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 75 - DNA, 441 bp, Artificial Sequence
  Synthetic nucleic acid sequence
  15_11F9
atgattgaagtcaaaccaataaacgcggaagatacgtatgagatcaggcaccgcattctccggccgaatcagccgctggaagcatgcaagtatgaaaccgatttgctcaggggtgcgtttcaccttggtggatattaccggggcaagctggtcagcatcgcctcctttaatcaagccgaacatccagagcttgaaggccaaaaacagtatcagctgagagggatggcgacactcgaaggataccgtgagcaaaaagcgggcagtacgcttatccgccatgccgaagagcttcttcggagaaagggggcagaccttttatggtgcaacgccaggacatctgcgagcggctactataaaaagctcggcttcagcgaacagggcgaagtctacgacataccgccgaccggaccccatattttgatgtataagaaattgacgtaa

SEQ ID NO: 76 - DNA, 441 bp, Artificial Sequence; identical to SEQ ID NO: 33
  Synthetic nucleic acid sequence
  15_11H3

SEQ ID NO: 77 - DNA, 441 bp, Artificial Sequence
  Synthetic nucleic acid sequence
  15_12A8
atgattgaagtcaaaccaataaacgcggaagatacgtatgagatcaggcaccgcattctccggccgaatcagccgctggaagcatgcaagtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacacttgaaggataccgtgagcaaaaagcgggcagtacgcttatccgccatgccgaagcgcttcttcggaaaaagggggcagacctcttatggtgcaacgccaggacatctgcgagcgggtactataaaaagctcggcttcagcgaacagggcgaagtctacgacataccgccgaccggaccccatattttgatgtataagaaattgacgtaa

SEQ ID NO: 78 - DNA, 441 bp, Artificial Sequence
  Synthetic nucleic acid sequence
  15_12D6
atgattgaagtcaaaccaataaacgcggaagatacgtatgagatcaggcaccgcattctccggccgaatcagccgctggaagcatgtatgtatgaaaccgatttgctcaggggtgcgtttcacctcggcggatattaccggggcaagctggtcagcatcgcctcctttcatcaagccgaacatccagagcttgaaggccaaaaacagtatcagctgagagggatggcgacacttgaagggtaccgtgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacacaccgccggtcggacctcatattttgatgtataagaagttgacgtaa

SEQ ID NO: 79 - DNA, 441 bp, Artificial Sequence
  Synthetic nucleic acid sequence
  15_12D8
atgattgaagtcaaaccaataaacgcggaagatacgtatgagatcaggcaccgcatactccggccgaatcagccgctggaagcatgcaagtatgaaaccgatttgctcgggggtacgtttcacctcggcggatattaccggggcaagctggtcagcatcgcctcctttcatcaagccgaacatccagagcttgaaggccaaaaacagtatcaactgagagggatggcgacacttgaaggataccgtgagcaaaaagcgggcagtacgcttatccgccatgccgaagagcttcttcggaaaaaaggcgcggaccttttatggtgcaacgccaggacgtctgcgagcgggtactataaaaagctcggcttcagcgaacagggcaaagtctacgacataccgccggtcggacctcatattttgatgtataagaaattgacgtaa

SEQ ID NO: 80 - DNA, 441 bp, Artificial Sequence
  Synthetic nucleic acid sequence
  15_12D9
atgattgaagtcaaaccaataaacgcggaggatacgtatgagatcaggcaccgcattctccggccgaatcagccgctggaagcatgcaagtatgaaaccgatttgctcaggggtacgtttcacctcggcggatattaccggggcaagctggtcagcatcgcctcctttcatcaagccgaacatccagagcttgaaggccaaaaacagtatcagctgagagggatggcgacactcgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacagggcgaagtctacgacataccgccggtcggacctcatattttgatgtataagaaattgacataa

SEQ ID NO: 81 - DNA, 441 bp, Artificial Sequence
  Synthetic nucleic acid sequence
  15_3F10
atgattgaagtcaaaccaataaacgcggaagatacgtatgagatcaggcaccgcattctccggccgaatcagccgctggaagcatgcaagtatgaaaccgatttgctcaggggtgcgtttcaccttggtggatattaccggggcaagctgatcagcatcgtttcctttcatcaagccgaacatccagagcttgaaggccaaaaacagtatcagctgagagggatggcgacacttgaagggtaccgtgagcaaaaagcgggcagcacgcttatccgccatgccgaagagcttcttcggaaaaaaggcgcggaccttttatggtgcaacgccaggacatctgcgagcgggtactataaaaagctcggcttcagcgaacagggcgaagtctacgacacaccgccggccggacctcatattttgatgtatacgaaattgacgtaa

SEQ ID NO: 82 - DNA, 441 bp, Artificial Sequence
  Synthetic nucleic acid sequence
  15_3G11
atgattgaagttaaaccaataaacgcggaagatacgtatgagatcaggcaccgcatactccggccgaatcagccgcttgaagcatgcaagtatgaaaccgatttgctcgggggtacgtttcacctcggcggatattaccggggcaagctggtcagcatcgcctcctttcatcaagccgaacatccagagcttgaaggccaaaaacagtatcagctgagagggatggcgacacttgaagagtaccgcgagcaaaaagcgggcagtacgcttatccgccatgccgaagagcttcttcggaaaaaaggcgcggaccttttgtggtgcaacgccaggacgtctgcgagcgggtactataaaaagctcggcttcagcgaacagggcgaagtctacgacataccgccggtcggacctcatattttgatgtataagaaattgacgtaa

SEQ ID NO: 83 - DNA, 441 bp, Artificial Sequence
  Synthetic nucleic acid sequence
  15_4F11
atgattgaagtcaaaccaataaacgcggaagatacgtataagatcaggcaccgcatactccggccgaatcagccgcttgaagcatgtatgtatgaaaccgatttgctcgggggcacgtttcacctcggtggatattaccggggcaagctggtcagcatcgcttcctttaatcaagccgaacatccagagcttgaaggccaaaaacagtatcagctgagagggatggcgacacttgaagggtaccgtgagcaaaaagcgggcagtacgcttatccgccatgccgaagcgcttcttcggaagaaaggcgcggaccttttatggtgcaacgccaggacatctgcgagcgggtactataaaaagctcggcttcagcgaacagggcgaagtctacgacataccgccgaccggaccccatattttgatgtataagaaattgacgtaa

SEQ ID NO: 84 - DNA, 441 bp, Artificial Sequence
  Synthetic nucleic acid sequence
  15_4H3
atgattgaagtcaaaccaataaacgcggaagatacgtatgagatcaggcaccgcattctccggccgaatcagccgcttgaagcatgcaagtatgaaaccgatttgctcgggggtacgtttcacctcggcggatattaccggggcaagctggtcagcatcgcttcctttcatcaagccgaacatccagagcttgaaggccaaaaacagtatcagctgagagggatggcgacacttgaagagtaccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgccgactgggccccatattttgatgtataagaaattgacgtaa

SEQ ID NO: 85 - DNA, 441 bp, Artificial Sequence
  Synthetic nucleic acid sequence
  15_6D3
atgattgaagtcaaaccaataaacgcggaagatacgtatgagatcaggcaccgcatactccggccgaatcagccgctggaagcatgcaagtatgaaaccgatttgctcgggggtacgtttcacctcggtggatattaccggggcaagctgatcagcatcgcctcctttcatcaagccgaacacccagagcttgaaggccaaaaacagtatcagctgagagggatggcgacacttgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacagggcgaagtctacgacataccgccgaccggaccccatattttgatgtataagaaattgacgtaa

SEQ ID NO: 86 - DNA, 441 bp, Artificial Sequence
  Synthetic nucleic acid sequence
  15_6G11
atgattgaagtcaaaccaataaacgcggaagatacgtatgagatcaggcaccgcattctccggccgaatcagccgctggaagcatgcaagtatgaaaccgatttgctcaggggtgcgtttcacctcggtggatattaccggggcaagctggtcagcatcgcctcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacagggcaaagtctacgacataccgccggtcggacctcatattttgatgtataagaagttgacgtaa

SEQ ID NO: 87 - DNA, 441 bp, Artificial Sequence
  Synthetic nucleic acid sequence
  15_9F6
atgattgaagtcaaaccaataaacgcggaagatacgtatgagatcaggcaccgcattctccggccgaatcagccgctggaagcatgcaagtatgaaaccgatttgctcgggggtacgtttcacctcggcggatattaccggggcaagctgatcagcatcgcctcctttcatcaagccgaacatccagagcttgaaggccaaaaacagtatcagctgagagggatggcgacactcgaagagtaccgcgagcaaaaagcgggcagtacgcttatccgccatgccgaagagcttcttcggagaaaaggcgcggaccttttatggtgcaacgccaggacatctgcgagcgggtactataaaaagctcggcttcagcgaacagggcgaagtctacgacataccgcctgtcggacctcatattttgatgtataagaaattgacgtaa

SEQ ID NO: 88 - DNA, 441 bp, Artificial Sequence
  Synthetic nucleic acid sequence
  15F5
atgatcgaagtcaaaccaataaacgcggaagatacgtatgagatcaggcaccgcattctccggccgaatcagccgctggaagcatgcaagtatgaaaccgatttgctcgggggtacgtttcacctcggtgggtactaccggggcaagctgatcagcatcgcttcctttcataaagccgaacattcagagcttgagggcgaagaacagtatcagctgagagggatggcgacgcttgaaggataccgtgagcaaaaagcgggcagtacgcttatccgctatgccgaagagcttcttcgaaaaaaaggcgcggaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 89 - DNA, 441 bp, Artificial Sequence
  Synthetic nucleic acid sequence
  16A1
atgattgaagtcaaacctataaacgcggaagatacgtatgagatcaggcaccgcattctccggccgaatcagccgcttgaagcatgtatgtatgaaaccgatttgctcgggggtacgcttcacctcggtggatattaccagggcaagctgatcagcatcgcttcctttcataaagccgaacattcagggcttgagggcgaagaacagtatcagctgagagggatggcgacgctcgaagggtaccgcgagcaaaaagcgggcagtacgcttatccgccatgccgaagagcttcttcgaaaaaaaggcgcggaccttttatggtgcaatgccaggacatctgtgagcggctactatgaaaagctcggcttcagcgaacagggcgaagtctacgacataccgccgatcggacctcatattttgatgtataagaaattgacgtaa

SEQ ID NO: 90 - DNA, 441 bp, Artificial Sequence
  Synthetic nucleic acid sequence
  16H3
atgattgacgtcaaacctataaacgcggaagatacgtatgagatcaggcaccgcattctccggccgaatcagccgctggaagcatgcaagtatgaaaccgatttgctcgggggcacgtttcacctcggcggatattaccagggcaagctgatcagcatcgcctcctttcatcaagccgaacattcagagcttgaaggccaaaaacagtatcagctgagagggatggcgacacttgaagggtaccgcgagcaaaaagcgggaagtacgctcatccgccatgccgaagagcttcttcggaaaaagggggcagaccttttatggtgcaatgccaggacatctgtgagcgggtactatgaaaagctcggcttcagcgaacagggcgaagtctacgacataccgccgatcggacctcatattttgatgtataagaaattgacgtaa

SEQ ID NO: 91 - DNA, 441 bp, Artificial Sequence
  Synthetic nucleic acid sequence
  17C12
atgattgaagtcaaaccaataagcgcggaagatacgtatgagatcaggcaccgcattctccggccgaatcagccgctggaagcatgtatgtatgaaaccgatttgctcgggggtgcgtttcacctcggtggatattaccagggcaagctgatcagcatcgcctcctttcatcaagccgaacattcagagcttgaaggccaaaaacagtatcagctgagagggatggcgacacttgaagggtaccgcgagcaaaaagcgggaagtacgcttatccgccatgccgaagagcttcttcgaaaaaaaggcgcggaccttttatggtgcaacgccaggacatctgtgagcgggtactatgaaaagctcggcttcagcgaacagggcgaagtctacgacataccgccgatcggacctcatattttgatgtataagaaattgacgtaa

SEQ ID NO: 92 - DNA, 441 bp, Artificial Sequence
  Synthetic nucleic acid sequence
  18D6
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctgatcagcatcgcttcctttcataaagccgaacattcagagcttgaaggccaaaaacagtatcagctgagagggatggcaacgcttgaaggataccgtgagcaaaaagcgggaagtacgcttatccgccatgccgaagagcttcttcggaaaaagggggcagaccttttatggtgcaacgccaggacatctgcgagcggctactatgaaaagctcggcttcagcgaacagggcgaagtctacgacataccgccgatcggacctcatattttgatgtataagaaattggcataa

SEQ ID NO: 93 - DNA, 441 bp, Artificial Sequence
  Synthetic nucleic acid sequence
  19C6
atgattgaagtcaaaccaataaacgcggaagatacgtatgagatcaggcaccgcattctccggccgaatcagccgctggaagcatgcaagtatgaaaccgatttgctcgggggtacgtttcacctcggtggatattaccggggcaagctgatctgcatcgcctcctttcatcaagccgaacattcagagcttgaaggccaaaaacagtatcagctgagagggatggcgacgcttgaagggtaccgcgagcaaaaagcgggaagtacgcttatccgccatgccgaagagcttcttcggaaaaagggggcagaccttttatggtgcaatgccaggacatctgtgagaggctactatgaaaagctcggcttcagcgaacaaggcggggtctacgatataccgccgatcggacctcatattttgatgtataagaaattggcgtaa

SEQ ID NO: 94 - DNA, 441 bp, Artificial Sequence
  Synthetic nucleic acid sequence
  19D5
atgattgaagtcaaaccaataaacgcggaagatacgtatgagatcaggcactgcattctccggccgaatcagccgcttgaagcatgtatgtatgaaaccgatttgctcgggggtacgtttcacctcggtggatattaccagggcaagctgatcagcatcgcttcctttcataaagccgaacattcagagcttgaaggccaaaaacagtatcagctgagagggatggcgacgcttgaagggtaccgcgagcaaaaagcgggcagtacgctcatccgccatgccgaagagcttcttcggaaaaagggggcagaccttttatggtgcaatgccaggacatctgtgagcggctactataaaaagctcggcttcagcgaacagggcgaagtctacgacataccgccgatcggacctcatattttgatgtataagaaattgacgtaa

SEQ ID NO: 95 - DNA, 441 bp, Artificial Sequence
  Synthetic nucleic acid sequence
  20A12
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccagggcaagctgatcagcatcgcttcctttcataatgccgaacattcagagcttgaaggccaaaaacagtatcagctgagagggatggcgacgcttgaagggtaccgtgagcaaaaagcgggaagcacgctcatccgccatgccgaagagcttcttcggaaaaagggggtagaccttttatggtgcaacgccaggacatctgtgagcgggtactataaaaagctcggcttcagcgaacaaggcgggatctacgacataccgccgatcggacctcatattttgatgtataagaaattggcataa

SEQ ID NO: 96 - DNA, 441 bp, Artificial Sequence
  Synthetic nucleic acid sequence
  20F2
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcttcctttcatcaagccgaacattcagagcttgaaggccaaaaacagtatcagctgagagggatggcgacacttgaagggtaccgcgagcaaaaagcgggaagtacgcttatccgccatgccgaagagcttcttcggaaaaaaggcgcagaccttttatggtgcaacgccaggacatctgtgagcggctactatgaaaagctcggcttcagcgaacagggcgaagtctacgacataccgccgatcggacctcatattttgatgtataagaaattgacgtaa

SEQ ID NO: 97 - DNA, 441 bp, Artificial Sequence
  Synthetic nucleic acid sequence
  21E11
atgattgaagtcaaaccaataaacgcggaagatacgtatgagatcaggcaccgcattctccggccgaatcagccgctggaagcatgcaagtatgaaaccgatttgctcgggggtgcgtttcacctcggtggatattaccagggcaagctgatcagcatcgcttcctttcatcaagccgaacattcagagcttgaaggccaaaaacagtatcagctgagagggatggcgacgcttgaaggataccgtgagcaaaaagcgggaagcacgctcatccgccatgccgaagagcttcttcggaaaaaaggcgcagaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 98 - DNA, 441 bp, Artificial Sequence
  Synthetic nucleic acid sequence
  23H11
atgattgaagtcaaaccaataaacgcggaagatacgtatgagatcaggcaccgcattctccggccgaatcagccgctggaggcatgtatgtatgaaaccgatttgctcgggggtacgtttcacctcggtggatattaccagggcaagctgatcagcatcgcttcctttcataaagccgaacattcagagcttgaaggccaaaaacagtatcagctgagagggatggcgacgcttgaagggtaccgcgagcaaaaagcgggcagtacgcttatccgccatgccgaagagcttctccgaaaaaaaggcgcggaccttttatggtgcaatgccaggacatctgcgagcggctactatgaaaagctcggcttcagcgaacagggcgaagtctacgacataccaccgatcggacctcatattttgatgtataagaaattggcataa

SEQ ID NO: 99 - DNA, 441 bp, Artificial Sequence
  Synthetic nucleic acid sequence
  24C1
atgattgaagtcaaaccaataaacgcggaagatacgtatgagatcaggcaccgcattctccggccgaatcagccgctggaagcatgcaagtatgaaaccgatttgctcgggggcacgtttcacctcggcggatattatcgggacaggctgatcagcatcgcttcctttcatcaagccgaacattcagagcttgaaggccaaaaacagtatcagctgagagggatggcgacgcttgaagggtaccgcgagcaaaaagcgggaagcacgctcatccgccatgccgaagagcttcttcggaaaaagggggcagaccttttatggtgcaacgccaggacatctgtgagcgggtactataaaaagctcggcttcagcgaacagggcgaagtctacgacataccgccgatcggacctcatattttgatgtataagaaactgacgtaa

SEQ ID NO: 100 - DNA, 441 bp, Artificial Sequence
  Synthetic nucleic acid sequence
  24C6
atgattgaagtcaaacctataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcttcctttcatcaagccgaacattcagagcttgaaggccaaaaacagtatcagctgagagggatggcgacgcttgaagggtaccgcgagcaaaaagcgggaagtacgcttatccgccatgccgaagagcttcttcgaaaaaaaggcgcggaccttttatggtgcaacgccaggatatctgtgagcggctactataaaaagctcggcttcagcgaacaaggcggggtctacgacataccgccgatcggacctcatattttgatgtataagaaattggcataa

SEQ ID NO: 101 - DNA, 441 bp, Artificial Sequence
  Synthetic nucleic acid sequence
  24E7
atgattgaagtcaaaccaataaacgcggaagatacgtatgagatcaggcaccgcattctccggccgaatcagccgctggaggcatgcaagtatgaaaccgatttgctcgggggcacgtttcatctcggtggatattaccggggcaagctgatcagcatcgcttcctttcataatgccgaacattcagagcttgaaggccaaaaacagtatcagctgagagggatggcgacgcttgaaggataccgcgagcaaaaagcgggcagtacgcttatccgccatgccgaagagcttcttcggaaaaagggggcagaccttttatggtgcaatgccaggacatctgcgagcggctactatgaaaagctcggcttcagcgaacagggcgaagtctacgacataccgccgatcggacctcatattttgatgtataagaaattggcataa

SEQ ID NO: 102 - DNA, 441 bp, Artificial Sequence
  Synthetic nucleic acid sequence
  2_8C3
atgattgaagtcaaaccaataaacgcggaagatacgtatgagatcaggcaccgtattctccggccgaatcagccgcttgaagcatgtatgtatgaaaccgatttgctcgggggtacgtttcacctcggcggatattatcgggacaggctgatcagcatcgcctcctttcatcaagccgaacattcagagcttgaaggccaaaaacagtatcagctgagagggatggcgacgcttgaagggtaccgcgagcaaaaagcgggcagtacgcttatccgccatgccgaagagcttcttcggaaaaagggggcagaccttttatggtgcaacgccaggacatctgcgagcggctactatgaaaagctcggcttcagcgaacagggcgaagtctacgacataccgccgatcggacctcatattttgatgtataagaaattgacgtaa

SEQ ID NO: 103 - DNA, 441 bp, Artificial Sequence
  Synthetic nucleic acid sequence
  2H3
atgattgaagtcaaaccgataaacgcggaagatacgtatgagatcaggcaccgcattctccggccgaatcagccgctggaagcatgcaagtatgaaaccgatttgctcgggggtacgtttcacctcggtggatattaccagggcaagctgatcagcaccgcttcctttcatcaagccggacattcagagcttgaaggccaaaaacagtatcagctgagagggatggcgacacttgaagggtaccgcgagcgaaaagcgggaagtacgctcatccgccatgccgaagagcttcttcggaaaaagggggcagaccttttatggtgcaacgccaggatatctgcgagcgggtactataaaaagctcggcttcagcgaacaaggcggggtctacgatataccgccgatcggacctcatattttgatgtataagaaattgacgtaa

SEQ ID NO: 104 - DNA, 441 bp, Artificial Sequence
  Synthetic nucleic acid sequence
  30G8
atgattgaagtcaaaccaataaacgcggaagatacgtatgagatcaggcaccgcattctccggccgaatcagccgcttgaagcatgtatgtttgaaaccgatttgctcgggggtgcgtttcacctcggtggatattaccagggcaagctgatcagcatcgcttcctttcatcaagccgaacattcagagcttgaaggccaaaaacagtatcagctgagagggatggcgacgcttgaagggtaccgcgagcaaaaagcgggcagtacgcttatccgccatgccgaagagcttcttcggaaaaaaggcgcagaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 105 - DNA, 441 bp, Artificial Sequence
  Synthetic nucleic acid sequence
  3B_10C4
atgattgaagtcagaccaataaacgcggaagatacgtatgagatcaggcaccgtattctccggccgaatcagccgcttgaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaaggataccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagcctacgacataccgccgatcggacctcatattttgatgtataagaaattgacgtaa

SEQ ID NO: 106 - DNA, 441 bp, Artificial Sequence
  Synthetic nucleic acid sequence
  3B_10G7
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcctcctttcatcaagccgaacattcagagcttgaaggccaaaaacagtatcagctgagagggatggcgacgcttgaagggtaccgcgagcaaaaagcgggcagtacgcttatccgccatgccgaagagcttcttcggaaaaaaggcgcggaccttttatggtgcaacgccaggacatctgcgagcgggtactataaaaagctcggcttcagcgaacaaggcggggtctacgacataccgccgatcggaccccatattttgatgtataagaaattgacgtaa

SEQ ID NO: 107 - DNA, 441 bp, Artificial Sequence
  Synthetic nucleic acid sequence
  3B_12B1
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaagggtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccgatcggacctcatattttgatgtataagaaattgacgtaa

SEQ ID NO: 108 - DNA, 441 bp, Artificial Sequence
  Synthetic nucleic acid sequence
  3B_12D10
atgattgaagtcaaaccaataaacgcggaagatacgtatgagatcaggcaccgtattctccggccgaatcagccgctggaagcatgtatgtacgaaaccgatttgctcgggggtgcgtttcacctcggtggatattaccggggcaagctgatcagcatcgcctcctttcatccagccgaacattcagagcttgaaggccaaaaacagtatcagctgagagggatggcgacacttgaaggataccgtgagcaaaaagcgggcagtacgcttatccgccatgccgaagagcttcttcggaaaaaaggcgcggaccttttatggtgcaacgccaggatatctgcgagcgggtactatgaaaagctcggcttcagcgaacagggcgaagtctacgacataccgccgatcggaccccatattttgatgtataagaaattgacgtaa

SEQ ID NO: 109 - DNA, 441 bp, Artificial Sequence
  Synthetic nucleic acid sequence
  3B_2E5
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaaggataccgtgagcaaaaagcgggcagtacgcttatccgccatgccgaagagcttcttcggaaaaagggcgcggaccttttatggtgcaacgccaggacatctgcgagcggctactatgaaaagctcggcttcagcaaacagggcgaagtctacgacataccgccgatcggacctcatattttgatgtataagaaattgacgtaa

SEQ ID NO: 110 - DNA, 441 bp, Artificial Sequence
  Synthetic nucleic acid sequence
  3C_10H3
atgattgaagtcaaaccaataaacgcggaagatacgtatgagatcaggcaccgtattctccggccgaatcagccgcttgaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaaggataccgtgagcaaaaagcgggaagtacgcttatccgccatgccgaagagcttcttcggaaaaagggggcagaccttttatggtgcaacgccaggatatctgcgagcggctactataaaaagctcggcttcagcgaacaaggcggggtctacgacataccgccggtcggacctcatattttgatgtataagaaattgacgtaa

SEQ ID NO: 111 - DNA, 441 bp, Artificial Sequence
  Synthetic nucleic acid sequence
  3C_12H10
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaagggtaccgtgggcaaaaagcgggcagtacgcttatccgccatgccgaagagcttcttcggaaaaaaggcgcggaccttttatggtgcaacgccaggacatctgcgagcggctactatgaaaagctcggcttcagcgaacagggcgaagtctacgacataccgccgatcggacctcatattttgatgtataagaaattgacgtaa

SEQ ID NO: 112 - DNA, 441 bp, Artificial Sequence
  Synthetic nucleic acid sequence
  3C_9H8
atgattgaagtcaaaccaataaacgcggaagatacgtatgagatcaggcaccgtattctccggccgaatcagccgcttgaagcatgtatgtatgaaaccgatttgctcgggggcacgtttcacctcggcggatattatcaggacaggctgatcagcatcgcctcctttcatcaagccgaacattcagagcttgaaggccaaaaacagtatcagctgagagggatggcgacacttgaagggtaccgcgagcaaaaagcgggaagtacgcttatccgctatgccgaagagcttcttcggaaaaaaggcgcggaccttttatggtgcaacgccaggatatctgcgagcggctactatgaaaagctcggcttcagcgaacagggcgaagtctacgacataccgccgatcggacctcatattttgatgtataagaaattgacgtaa

SEQ ID NO: 113 - DNA, 441 bp, Artificial Sequence
  Synthetic nucleic acid sequence
  4A_1B11
atgattgaagtcaaacctataaacgcggaagatacgtatgagatcaggcaccgcatactccggccgaatcagccgcttgaagcatgtatgtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacgcttgaagggtaccgcgagcaaaaagcgggcagtacgcttatccgccatgccgaagagcttcttcggaaaaagggggcagaccttttatggtgcaacgccaggacatctgcgagcggctactatgaaaagctcggcttcagcgaacagggcgaagtctacgacataccgccgatcggacctcatattttgatgtataagaaattgacgtaa

SEQ ID NO: 114 - DNA, 441 bp, Artificial Sequence
  Synthetic nucleic acid sequence
  4A_1C2
atgattgaagtcaaaccaataaacgcggaagatacgtatgagatcaggcaccgcattctccggccgaatcagccgctggaagcatgcaagtatgaaaccgatttgctcgggggcacgtttcacctcggcggatattatcggggcaagctgatcagcatcgcctcctttcatcaagccgaacattcagagcttgaaggccaaaaacagtatcagctgagagggatggcgacgcttgaagagtaccgcgagcaaaaagcgggcagtacgcttatccgccatgccgaagagcttcttcggaaaaaaggcgcagaccttttatggtgcaacgccaggacatctgcgagcgggtactataaaaagctcggcttcagcgaacagggcgaagtctacgacataccgccgatcggacctcatattttgatgtataagaaattgacgtaa

SEQ ID NO: 115 - DNA, 441 bp, Artificial Sequence
  Synthetic nucleic acid sequence
  4B_13E1
atgattgaagtcaaacctataaacgcggaagatacgtatgagatcaggcaccgcattctccggccgaatcagccgctggaagcatgcaagtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagagtaccgcgagcaaaaagcgggcagtacgcttatccgccatgccgaagagcttcttcggaaaaaaggcgcggaccttttgtggtgcaacgccaggatatctgcgagcggctactatgaaaagctcggcttcagcgaacagggcgaagtctacgacataccgccgatcggacctcatattttgatgtataagaaattgacgtaa

SEQ ID NO: 116 - DNA, 441 bp, Artificial Sequence
  Synthetic nucleic acid sequence
  4B_13G10
ttacgtcaatttcttatacatcaaaatatgaggtccgatcggcggtatgtcgtagacttcgccctgttcgctgaagccgagctttttatagtacccgctcgcagatgtcctggcgttgcaccataaaaggtccgcgccttttttccgaagaagctcttcggcatggcggatgagcgtgcttcccgctttttgctcgcggtacccttcaagcgtcgccatccctctcagctgatactgtttttggccttcaagctctgaatgttcggcttgatgaaaggaggcgatgctgatcagcttgccccggtaatatccaccgaggtgaaacgtgcccccgagcaaatcagtttcatacttgcatgcttccagcggctgattcggccggagaatgcggtgcctgatctcatacgtatcttccgcgtttattggtttggcttcaatcat

SEQ ID NO: 117 - DNA, 441 bp, Artificial Sequence
  Synthetic nucleic acid sequence
  4B_16E1
atgattgaagtcaaaccaataaacgcggaagatacgtatgagatcaggcaccgcattctccggccgaatcagccgctggaagcatgcaagtatgaaaccgatttgctcgggggtacgtttcacctcggcggatattaccggggcaagctgatcagcatcgcctcctttcatcaagccgaacattcagagcttgaaggccaaaaacagtatcagctgagagggatggcgacacttgaagggtaccgcgagcaaaaagcgggcagtacgcttatccgccatgccgaagagcttcttcggaaaaagggggcagaccttttatggtgcaacgccaggacatctgcgagcgggtactataaaaagctcggcttcagcgaacaaggcggggtctacgatataccgccgatcggacctcatattttgatgtataagaaattgacgtaa

SEQ ID NO: 118 - DNA, 441 bp, Artificial Sequence
  Synthetic nucleic acid sequence
  4B_17A1
atgattgaagtcaaaccaataaacgcggaagatacgtatgagatcaggcaccgcattctccggccgaatcagccgctggaagcatgcaagtatgaaaccgatttgctcgggggcacgtttcacctcggcggatattaccggggcaagctgatcagcatcgcttcctttcatcaagccgagcatccagagcttgaaggccaaaaacagtatcagctgagagggatggcgacgcttgaagagtaccgcgagcaaaaagcgggcagtacgcttatccgccatgccgaagagcttcttcggaaaaagggggcagaccttttatggtgcaacgccaggacatctgcgagcggctactatgaaaagctcggcttcagcgaacagggcgaagtctacgacataccgccgatcggacctcatattttgatgtataagaaattgacataa

SEQ ID NO: 119 - DNA, 441 bp, Artificial Sequence
  Synthetic nucleic acid sequence
  4B_18F11
atgattgaagtcaatccaataaacgcggaagatacgtatgagatcaggcaccgcattctccggccgaatcagccgcttgaagcatgtatgtatgaaaccgatttgctcgggggcacgtctcacctcggcggatattaccggggcaagctgatcagcatcgcttcctttcataatgccgaacattcagagcttgatggccaaaaacagtatcagctgagagggatggcgacacttgaagggtaccgcgagcaaaaagcgggaagcacgctcatccgccatgccgaagagcttcttcggaaaaaaggcgcagaccttttatggtgcaacgccaggacatctgtgagcggctactatgaaaagctcggcttcagcgaacagggcgaagtctacgacataccgccgatcggacctcatatttcgatgtataagaaattgacgtaa

SEQ ID NO: 120 - DNA, 441 bp, Artificial Sequence
  Synthetic nucleic acid sequence
  4B_19C8
atgattgaagtcaaaccaataaacgcggaagatacgtatgagatcaggcaccgcattctccggccgaatcagccgctggaagcatgcaagtatgaaaccgatttgctcgggggcacgtttcacctcggcggatattaccggggcaagctgatcagcatcgcttcctttcatcaagccgaacatccagagcttgaaggccaaaaacagtatcagctgagagggatggcgacgcttgaagggtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacaaggcggggtctacgatataccgccgatcggacctcatattttgatgtataagaaattggcataa

SEQ ID NO: 121 - DNA, 441 bp, Artificial Sequence
  Synthetic nucleic acid sequence
  4B_1G4
atgattgaagtcaaaccaataaacgcggaagatacgtatgagatcaggcaccgcattctccggccgaatcagccgctggaagcatgcaagtatgaaaccgatttgctcgggggtgcgtttcacctcggcggatattaccggggcaagctgatcagcatcgcctcctttcatcaatccgaacatccagagcttgaaggccaaaaacagtatcagctgagagggatggcgacgcttgaagggtaccgcgagctaaaagcgggaagtacgcttatccgccatgccgaagagcttcttcggaaaaaaggcgcggaccttttatggtgcaacgccaggatatctgcgagcgggtactataaaaagctcggcttcagcgaacagggcgaagtctacgacataccgccgatcggacctcatattttgatgtataagaaattgacgtaa

SEQ ID NO: 122 - DNA, 441 bp, Artificial Sequence
  Synthetic nucleic acid sequence
  4B_21C6
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgaacattcagagcttgaaggccaaaaacagtatcagctgagagggatggcgacacttgaagagtaccgcgagcaaaaagcgggaagcacgctcatccgccatgccgaagagcttcttcggaaaaaaggcgcggaccttttatggtgcaacgccaggatatctgcgagcggctactataaaaagctcggcttcagcgaacaaggcggggtctacgatataccgccgatcggacctcatattttgatgtataagaaattgacgtaa

SEQ ID NO: 123 - DNA, 441 bp, Artificial Sequence
  Synthetic nucleic acid sequence
  4B_2H7
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcctcctttcatcaagccgaacattcagagcttgaaggccaaaaacagtaccagctgagagggatggcgacgcttgaagggtaccgcgagcaaaaagcgggcagtacgcttatccgccatgccgaagagcttcttcggaaaaagggggcagaccttttatggtgcaacgccaggacatctgcgagcggctactataaaaagctcggcttcagcgaacaaggcggggtctacggcataccgccgatcggacctcatattttgatgtataagaaattgacataa

SEQ ID NO: 124 - DNA, 441 bp, Artificial Sequence
  Synthetic nucleic acid sequence
  4B_2H8
atgattgaagccaaaccaataaacgcggaagatacgtatgagatcaggcaccgcattctccggccgaatcagccgctggaagcatgcaagtatgaaactgatttgctcgggggcacgtttcacctcggtggatattaccggggcaagctgatcagcatcgcctcctttcatcaagccgaacattcagagcttgaaggccaaaaacagtatcagctgagagggatggcgacgcttgaagggtaccgcgagcaaaaagcgggaagcacgctcatccgccatgccgaagagcttcttcggaaaaaaggcgcggaccttttatggtgcaacgccaggacatctgcgagcgggtactataaaaagctcggcttcagcgaacagggcgaagtctacgacataccgccgatcggacctcatattttgatgtataagaaattgacgtaa

SEQ ID NO: 125 - DNA, 441 bp, Artificial Sequence
  Synthetic nucleic acid sequence
  4B_6D8
atgattgaagtcaaaccaataaacgcggaagatacgtatgagatcaggcaccgcatactccggccgaatcagccgctggaagcatgcaagtatgaaaccgatttgctcgggggcacgtttcacctcggtggatattaccggggcaagctgatcagcatcgcttcctttcatcaagccgaacattcagagcttgaaggccaaaaacagtatcagctgagagggatggcgacgcttgaagggtaccgcgagcaaaaagcgggtagtacgcttatccgccatgccgaagagcttcttcggaaaaagggggcagaccttttatggtgcaacgccaggacatctgcgagcgggtactataaaaagctcggcttcagcgaacatggcgaagtctacgacataccgccgatcggacctcatattttgatgtataagaaattgacgtaa

SEQ ID NO: 126 - DNA, 441 bp, Artificial Sequence
  Synthetic nucleic acid sequence
  4B_7E8
atgattgaagtcaaaccaataaacgcggaagatacgtatgagatcaggcaccgcattctccggccgaatcagccgctggaagcatgcatgtatgaaaccgatttgctcgggggcacgtttcacctcggtggatattaccggggcaagctgatcagcatcgcttcctttcatcaagccgaacattcagagcttgaaggccaaaaacagtatcagctgagagggatggcgacacttgaagggtaccgcgagcaaaaagcgggcagtacgcttatccgccatgccgaagagcttcttcggaaaaagggggcagaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 127 - DNA, 441 bp, Artificial Sequence
  Synthetic nucleic acid sequence
  4C_8C9
atgattgaagtcaaaccaataaacgcggaagatacgtatgagatcaggcaccgcattctccggccgaatcagccgcttgaagcatgtatgtatgaaaccgatttgctcaggggtgcgtttcacctcggtggatattaccggggcaagctgatcagcatcgcttcctttcatcaagccgaacatccagagcttgaaggccaaaaacagtatcagctgagagggatggcgacacttgaaggataccgtgagcaaaaagcgggcagtacgcttatccgccatgccgaagagcttcttcggaaaaagggggcagaccttttatggtgcaacgccaggacatctgcgagcggctactatgaaaagctcggcttcagcgaacagggcgaagtctacgacataccgccgatcggacctcatattttgatgtataagaaattaacataa

SEQ ID NO: 128 - DNA, 441 bp, Artificial Sequence
  Synthetic nucleic acid sequence
  4H1
atgattgaggtgaaaccgattaacgcagaggagacctatgaactaaggcataggatactcagaccacaccagccgatagaggtttgtatgtatgaaaccgatttacttcgtggtgcgtttcacttaggcggcttttacaggggcaagctgatttccatagcttcattccaccaggccgagcatccagaactccagggccagaaacaataccaactccgaggtatggctaccttggaaggttatcgtgaccagaaagcgggatcgagcctaattaaacacgctgaacagatccttcggaagcggggggcggacatgctatggtgcaatgcgcggacatccgccgctggctactacaaaaagttaggcttcagcgagcagggagaggtatttgaaacgccgccagtaggacctcacatcgtaatgtataaacgcctcacataa

SEQ ID NO: 129 - DNA, 441 bp, Artificial Sequence
  Synthetic nucleic acid sequence
  6_14D10
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccgaggcaagctgatcagcatcgcctccttccatcaagccgaacattcagagcttgaaggccataaacagtatcagctgagagggatggcgacacttgaagagtaccgcgagcaaaaagcgggaagcacgctcatccgccatgccgaagagcttcttcggaaaaagggggcagaccttttatggtgcaacgccaggacatctgcgagcggctactataaaaagctcggcttcagcgaacaaggcggggtctacgacataccgccggtcggacctcatattttgatgtataagaaattgacgtaa

SEQ ID NO: 130 - DNA, 441 bp, Artificial Sequence
  Synthetic nucleic acid sequence
  6_15G7
atgattgaagtcaaaccaataaacgcggaagatacgtatgagatcaggcaccgcattctccggccgaatcagccgcttgaagcatgtaagtatgaaaccgatttgctcgggggcacgtttcacctcggcggatattaccggggcaagctgatcagcatcgcttcctttcatcaagccgaacattcagagcttgaaggccaaaaacagtatcagctgagagggatggcgacacttgaagggtaccgcgagcaaaaagcgggaagcacgctcatccgccatgccgaagagcttcttcggaaaaaaggcgcggaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 131 - DNA, 441 bp, Artificial Sequence
  Synthetic nucleic acid sequence
  6_16A5
atgattgaagtcaaaccaataaacgcggaagatacgtatgagatcaggcaccgcattctccggccgaatcagccgctggaagcatgcaagtatgaaaccgatttgctcgggggtacgtttcacctcggtggatattaccggggcaagctgatcagcatcgcctcctttcaccaagccgaacattcagagcttgaaggccaaaaacagtatcagctgagagggatggcgacacttgaaggataccgtgagcaaaaagcgggaagtacgcttatccgccatgccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 132 - DNA, 441 bp, Artificial Sequence
  Synthetic nucleic acid sequence
  6_16F5
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgtacattcagagcttgaaggccaaaaacagtatcagctgagagggatggcgacacttgaaggataccgtgagcaaaaagcgggcagtacgcttatccgccatgccgaagagcttcttcggaaaaagggggcagaccttttatggtgcaacgccaggacatctgcgagcggctactataaaaagctcggcttcagcgaacaaggcggggtctacgacataccgccggtcggacctcatattttgatgtataagaaattgacgtaa

SEQ ID NO: 133 - DNA, 441 bp, Artificial Sequence
  Synthetic nucleic acid sequence
  6_17C5
atgattgaagtcaaaccaataaacgcggaagatacgtatgagatcaggcaccgcattctccggccgaatcagccgcttgaagcatgcaagtatgaagccgatttgctcgggggcacgtttcacctcggtggatattaccggggcaagctgatcagcatcgcttcctttcatcaagccgagcatccagagcttgaaggccaaaaacagtatcagctgagagggatggcgacacttgaaggaaaccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacgtaccgccgatcggacctcatattttgatgtataagaaattgacgtaa

SEQ ID NO: 134 - DNA, 441 bp, Artificial Sequence
  Synthetic nucleic acid sequence
  6_18C7
atgattgaagtcaaaccaataaacgcggaagatacgtatgagatcaggcaccgcattctccggccgaatcagccgctggaagcatgcaggtatgaaaccgatttgctcgggggcacgtttcacctcggtggatattatcggggcaagctgatcagcatcgcttcctttcatcaagccgaacatccagagcttgaaggccaaaaacagtatcagctgagagggatggcgacgcttgaaggataccgtgagcaaaaagcgggcagtacgcttatccgccatgccgaagagcttcttcggaaaaagggggcagaccttttatggtgcaacgccaggatatctgcgagcgggtactataaaaagctcggcttcagcgaacagggcgaagtttacgacataccgccggtcggacctcatattttgatgtataagaaattgacgtaa

SEQ ID NO: 135 - DNA, 441 bp, Artificial Sequence
  Synthetic nucleic acid sequence
  6_18D7
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacacttgaagggtaccgcgagcaaaaagcgggaagcacgctcatccgccatgccgaagagcttcttcggaaaaaaggcgcggaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 136 - DNA, 441 bp, Artificial Sequence
  Synthetic nucleic acid sequence
  6_19A10
atgattgaagccaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacacttgaagggtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccgaccggaccccatattttgatgtataagaaattgacgtaa

SEQ ID NO: 137 - DNA, 441 bp, Artificial Sequence
  Synthetic nucleic acid sequence
  6_19B6
atgattgaagtcaaaccaataaacgcggaagatacgtatgagatcaggcaccgcattctccggccgaatcagccgcttgaagcatgtatgtatgaaaccgatttgctcaggggtgcgtttcacctcggtggatattatcggggcaagctgatcagcatcgcttcctttcatcaagccgaacattcagagcttgaaggccaaaaacagtatcagctgagagggatggcgacactcgaaggataccgtgagcaaaaagcgggcagtacgcttatccgccatgccgaagagcttcttcggaaaaagggcgcagaccttttatggtgcaacgccaggacatctgcgagcggctactataaaaagctcggcttcagcgaacagggcgaagtctacgacataccgccggtcggacctcatattttgatgtataagaaattgacgtaa

SEQ ID NO: 138 - DNA, 441 bp, Artificial Sequence
  Synthetic nucleic acid sequence
  6_19C3
atgattgaagtcaaaccaataaacgcggaagatacgtatgagatcaggcaccgcattctccggccgaatcagccgctggaagcatgcaagtatgaaaccgatttgctcgggggtacgtttcacctcggcggatattaccggggcaagctgatcagcatcgcctcctttcatcaagccgaacatccagagcttgaaggccaaaaacagtatcagctgagagggatggcgacacttgaaggataccgtgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgccgatcggacctcatattttgatgtataagaaattgacgtaa

SEQ ID NO: 139 - DNA, 441 bp, Artificial Sequence
  Synthetic nucleic acid sequence
  6_19C8
atgattgaagtcaaaccaataaacgcggaagatacgtatgagatcaggcaccgcattctccggccgaatcagccgctggaagcatgcaagtatgaaaccgatttgctcgggggtacgttacacctcggtggatattaccggggcaagctgatcagcatcgcctcctttcatcaagccgaacatccagagcttgaaggccaaaaacagtatcagctgagagggatggcgacacttgaaggataccgtgagcaaaaagcgggcagtacgcttatccgccaagccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataaggaattgacgtaa

SEQ ID NO: 140 - DNA, 441 bp, Artificial Sequence
  Synthetic nucleic acid sequence
  6_20A7
atgattgaagtcaaaccaataaacgcggaagatacgtatgagatcaggcaccgcattctccggccgaatcagccgcttgaagcatgtatgtatgaaaccgatttgctcaggggcacgtttcacctcggcggatattaccggggcaagctgatcagcatcgcttcctttcatcaagccgaacattcagatcttgaaggccaaaaacagtatcagctgagagggatggcgacacttgaagagtaccgcgagcaaaaagcgggaagcacgctcatccgccatgccgaagagcttcttcggaaaaagggggcagaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 141 - DNA, 441 bp, Artificial Sequence
  Synthetic nucleic acid sequence
  6_20A9
atgattgaagtcaaaccaataaacgcgggagatacgtatgagatcaggcaccgcattctccggccgaatcagccgctggaagcatgcaagtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaagggtaccgcgagcaaaaagcgggcagtacgcttatccgccatgccgaagagcttctacggaaaaaaggcgcggaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 142 - DNA, 441 bp, Artificial Sequence
  Synthetic nucleic acid sequence
  6_20H5
atgattgaagtcaaaccaataaacgcggaagatacgtatgagatcaggcaccgcattctccggccgaatcagccgctggaagcatgcaagtatgaaaccgatttgctcgggggcacgtttcacctcggcggatattaccggggcaagctgatcagcatcgcctcctttcatcaagccgaacattcagagcttgaaggccaaaaacagtatcagctgagagggatggcgacacttgaaggataccgtgagcaaaaagcgggaagtacgcttatccgccatgccgaagagcttcttcggaaaaaaggcgcggaccttttatggtgcaacgccaggacatctgcgagcggctactataaaaagctcggcttcagcgaacagggcgaagtctacgacataccgccgatcggacctcatattttgatgtataagaaattgacgtaa

SEQ ID NO: 143 - DNA, 441 bp, Artificial Sequence
  Synthetic nucleic acid sequence
  6_21F4
atgattgaagtcaaaccaataaacgcggaagatacgtatgagatcaggcaccgcgttctccggccgaatcagccgctggaagcatgtatgtatgaaaccgatttgctcgggggtgcgtttcacctcggtggatattaccggggcaagctgatcagcatcgcctcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacgtaccgccggtcggacctcatattttgatgtataagaaattgacgtaa

SEQ ID NO: 144 - DNA, 441 bp, Artificial Sequence
  Synthetic nucleic acid sequence
  6_22C9
atgattgaagtcaaaccaataaacgcggaagatacgtatgagatcaggcaccgcattctccggccgaatcggccgcttgaagcatgtatgtatgaaaccgatttgctcgggggcacgtttcacctcggtggatattaccggggcaagctgatcagcatcgcctcctttcatcaagccgaacatccagggcttgaaggcaaaaaacagtatcagctgagagggatggcgacacttgaagagtaccgcgagcaaaaagcgggaagcacgcttatccgccatgccgaagagcttcttcggaaaaaaggcgcggaccttttatggtgcaacgccaggacttccgcgagcgggtactataaaaagctcggcttcagcgaacaaggaggggtctacgacataccgccggtcggacctcatattttgatgtataagaaattgacgtaa

SEQ ID NO: 145 - DNA, 441 bp, Artificial Sequence
  Synthetic nucleic acid sequence
  6_22D9
atgattgaagtcaaaccaataaacgcggaagatacgtatgagatcaggcaccgtattctccggccgaatcagccgctggaagcatgcatgtatgaaaccgatttgctcgagggcacgtttcacctcggtggatattaccggggcaagctgatcagcatcgcctcctttcatcaagccgagcattcagagcttgaaggccaaaaacagtatcagctgagagggatggcgacacttgaaggataccgtgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 146 - DNA, 441 bp, Artificial Sequence
  Synthetic nucleic acid sequence
  6_22H9
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacgcttgatgagtaccgcgagcaaaaagcgggcagtacgcttatccgccatgccgaagagcttcttcggaaaaaaggcgcagaccttttatggtgcaacgccaggacatctgcgagcgggtactataaaaagctcggcttcagcgaacagggcgaagtctacgacataccgccgatcggaccccatattttgatgtataagaaattgacgtaa

SEQ ID NO: 147 - DNA, 441 bp, Artificial Sequence
  Synthetic nucleic acid sequence
  6_23H3
atgattgaagtcaaaccaataaacgcggaagatacgtatgagatcaggcaccgcattctccggccgaatcagccgcttgaagcatgtatgtatggaactgatttgctcgggggcacgtttcacctcggtggatattaccggggcaagctgatcagcatcgcttcctttcatcaagccgagcaaccagagcttgaaggccaaaaacagtatcagctgagagggatggcgacacttgaagggtaccgcgagcaaaaagcgggcagtacgcttatccgccatgccgaagagcttcttcggaaaaagggggcagaccttttatggtgcaacgccaggacatctgcgagcgggtactataaaaagctcggcttcagcgagcaaggcggggtctacgacataccgccggtcggacctcatattttgatgtataagaaattgacgtaa

SEQ ID NO: 148 - DNA, 441 bp, Artificial Sequence
  Synthetic nucleic acid sequence
  6_23H7
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgaacattcagagcttgaaggccaaaaacagtatcagctgagagggatggcgacgcttgaaggataccgcgagcaaaaagcgggaagtacgcttatccgccatgcagaagagattcttcggaaaaaaggcgcggacctcttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 149 - DNA, 441 bp, Artificial Sequence
  Synthetic nucleic acid sequence
  6_2H1
atgattgaagtcaaaccaataaacgcggaagatacgtatgagatcaggcaccgcgttctccggccgaatcagccgctggaagcatgtatgtatgaaaccgatttgctcgggggcacgtttcacctcggtggatattaccggggcaagctgatcagcatcgcctcctttcatcaagccgaacatccagagcttgaaggccaaaaaccgtatcagctgagagggatggcgacacttgaaggataccgcgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaaatctacgacataccgccgatcggacctcatattttgatgtataagaaattgacgtaa

SEQ ID NO: 150 - DNA, 441 bp, Artificial Sequence
  Synthetic nucleic acid sequence
  6_3D6
atgattgaaatcaaaccaataaacgcggaagatacgtatgagatcaggcaccgcattctccggccgaatcagccgcttgaagcatgtatgtatgaaaccgatttgctcgggggtacgtttcacctcggtggatattaccgaggcaagctgatcagcatcgcctcctttcatcaagccgaacatccagagcttgaaggccaaaaacagtatcagctgagagggatggcgactcttgaaggataccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaggtctacgacataccgccggtcggacctcatattttgatgtataagaaattgacgtaa

SEQ ID NO: 151 - DNA, 441 bp, Artificial Sequence
  Synthetic nucleic acid sequence
  6_3G3
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaaggataccgtgagcaaaaagcgggcagtacgcttatccgccatgccgaagagcttcttcggaaaaaaggcgcggaccttttatggtgcaacgccaggacatctgcgagcggctactataaaaagctcggcttcagcgaacagggcgaagtctacgacataccgccggtcggacctcatattttgatgtataagaaattgacgtaa

SEQ ID NO: 152 - DNA, 441 bp, Artificial Sequence
  Synthetic nucleic acid sequence
  6_3H2
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcctcctttcatcaagccgaacatccagagcttgaaggccaaaaacagtatcagctgagagggatggcgacacttgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacagggcgaagtctacgacataccgccggtcggacctcatattttgatgtataagaaattgacataa

SEQ ID NO: 153 - DNA, 441 bp, Artificial Sequence
  Synthetic nucleic acid sequence
  6_4A10
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaaactgatcagcatcgcctcctttcatcaagccgaacatccagagcttgaaggccaaaaacagtatcagctgagagggatggcgacgcttgaaggataccgtgagcaaaaagcgggaagtacgcttatccgccatgccgaagagcttcttcggaaaaaaggcgcggaccttttatggtgcaacgccaggacatctgcgagcggctactataaaaagctcggcttcagcgaacagggcgaagtctacgacataccgccggtcggacctcatattttgatgtataagaaattgacgtaa

SEQ ID NO: 154 - DNA, 441 bp, Artificial Sequence
  Synthetic nucleic acid sequence
  6_4B1
atgattgaagtcaaaccaataaacgcggaagatacgtatgagatcaggcaccgcgtactccggccgaatcagccgcttgaagcatgtatgtatgaaaccgatttgctcgggggcacgtttcacctcggtggatattaccggggcaagctgatcggcatcgcttcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaagggggcagaccttttatggtgcaacgccaggacatctgcgagcggctactatgaaaagctcggcttcagcggacagggcgaagtctacgacataccgccgatcggacctcatattttgatgtataagaaattgacataa

SEQ ID NO: 155 - DNA, 441 bp, Artificial Sequence
  Synthetic nucleic acid sequence
  6_5D11
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagagtaccgcgagcaaaaagcgggcagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgccgatcggacctcatattttgatgtataagaaattgacgtaa

SEQ ID NO: 156 - DNA, 441 bp, Artificial Sequence
  Synthetic nucleic acid sequence
  6_5F11
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctaatcagcatcgcttcctttcatcaagccgaacatccagagcttgaaggccaaaaacagtatcagctgagagggatggcgacacttgaagagtaccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacagggcgaagtccacgacataccgccggtcggacctcatattttgatgtataagaaattgacgtaa

SEQ ID NO: 157 - DNA, 441 bp, Artificial Sequence
  Synthetic nucleic acid sequence
  6_5G9
atgattgaagtcaaaccaataaacgcggaagatacgtatgagatcaggcaccgcattctccggccgaatcagccgctggaagcatgtatgtatgaaaccgatttgctcgggggcacgtttcacctcggcggatattaccggggcaagctaatcagcatcgcctcctttcatcaagccgaacattcagagcttgaaggccaaaaacagtatcagctgagagggatggcgacgcttgaagagtaccgtgagcaaaaagcgggcagtacgcttatccgccatgccgaagagcttcttcggaaaaagggggcagaccttttatggtgcaacgccaggatatctgcgagcgggtactataaaaagctcggcttcagcgaacaaggcggggtctacgacataccgccggtcggacctcatattttgatgtataagaaattgacgtaa

SEQ ID NO: 158 - DNA, 441 bp, Artificial Sequence
  Synthetic nucleic acid sequence
  6_6D5
atgattgaagtcaaaccaataaacgcggaagatgcgtatgagatcaggcaccgcattctccggccgaatcagccgctggaagcatgcaagtatgaaactgatttgctcgggggcacgtttcacctcggcggatattaccggggcaagctgatcagcatcgcttcctttcatcaagccgaacattcagagcttgaaggccaaaaacagtatcagctgagagggatggcgacacttgaagggtaccgcgagcaaaaagcgggcagtacgcttatccgccatgccgaagagcttcttcggaaaaaaggcgcggaccttttgtggtgcaacgccaggacatctgcgagcgggtactataaaaagctcggcttcagcgaacaaggcggggtctacgacataccgccggtcggacctcatattttgatgtataagaaattgacgtaa

SEQ ID NO: 159 - DNA, 441 bp, Artificial Sequence
  Synthetic nucleic acid sequence
  6_7D1
atgattgaagtcaaaccaataaacgcggaagatacgtatgagatcaggcaccgcattctccggccgaatcagccgcttgaagcatgtatgtatgaaaccgatttgctcaggggtgcgtttcacctcggtggatattaccggggcaagctgatcagcatcgcttcctttcatcaagccgaacattcagagcttgaaggccaaaaacagtatcagctgagagggatggcgacacttgaaggataccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 160 - DNA, 441 bp, Artificial Sequence
  Synthetic nucleic acid sequence
  6_8H3
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcctcctttcatcaagccgaacatccagagcttgaaggccaaaaacagtatcagctgagagggatggcgacgcttgaagggtaccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 161 - DNA, 441 bp, Artificial Sequence
  Synthetic nucleic acid sequence
  6_9G11
atgattgaagtcaaaccaataaacgcggaagatacgtatgagatcaggcaccgcattctccggccgaatcagccgctggaagcatgcaagtatgaaaccgatttgctcgggggcacgcttcacctcggtggatattaccggggcaagctgatcagcatcgcttcctttcatcaagccgaacattcagagcttgaaggccaaaaacagtatcagctgagagggatggcgacgcttgaagggtaccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacaaggcgaagtctacgacataccgccggtcggacctcatattttgatgtataagaaattgacgtaa

SEQ ID NO: 162 - DNA, 441 bp, Artificial Sequence
  Synthetic nucleic acid sequence
  6F1
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctggtctgcatcgcttcctttcataaagccgaacattcagagcttgaaggccaaaaacagtatcagctgagagggatggcgacgcttgatggataccgcgagcaaaaagcgggaagcacgctcatccgccatgccgaagagcttcttcgaaaaaaaggcgcggaccttttatggtgcaatgccaggacatctgtgagcggctactatgaaaagctcggcttcagcgaacagggcgaagtctacgacataccgccggtcggacctcatattttgatgtataagaaattgacgtaa

SEQ ID NO: 163 - DNA, 441 bp, Artificial Sequence
  Synthetic nucleic acid sequence
  7_1C4
atgattgaagtcaaaccaataaacgcggaagatacgtatgagatcaggcaccgcattctccggccgaatcagccgctggaagcatgtatgtatgaaaccgatttgctcgggggcacgtttcacctcggtggatattaccggggcaagctgatcagcatcgcttcctttcatcaagccgagcatccagagcttgaaggccaaaaacagtatcagctgagagggatggcgacacttgaagagtaccgcgagcaaaaagcgggcagtacgcttatccgccatgccgaagagcttcttcggaaaaaaggcgcggaccttttatggtgcaacgccaggacatctgcgagcgggtactataaaaagctcggcttcagcgaacaaggcggggtctacgatataccgccgatcggacctcatattttgatgtataagaaattgacgtaa

SEQ ID NO: 164 - DNA, 441 bp, Artificial Sequence
  Synthetic nucleic acid sequence
  7_2A10
atgattgaagtcaaaccaataaacgcggaagatacgtatgagatcaggcaccgcattctccggccgaatcagccgctggaagcatgcaagtatgaaactgatttgctcgggggcacgtttcatctcggtggatattaccggggcaagctgatcagcatcgcctcctttcatcaagccgaacatccagagcttgaaggccaaaaacagtatcagctgagagggatggcgacgcttgaagggtaccgcgagcaaaaagcgggaagcacgctcatccgccatgccgaagagcttcttcggaaaaaaggcgcggaccttttatggtgcaacgccaggacatctgcgagcgggtactataaaaagctcggcttcagcgaacaaggcggggtctacgatataccgccgatcggacctcatattttgatgtataagaaattgacgtaa

SEQ ID NO: 165 - DNA, 441 bp, Artificial Sequence
  Synthetic nucleic acid sequence
  7_2A11
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgaacattcagagcttgaaggccaaaaacagtatcagctgagagggatggcgacacttgaagggtaccgcgagcaaaaagcgggaagtacgcttatccgccatgccgaagagcttcttcggaaaaagggggcagaccttttatggtgcaacgccaggacatctgcgagcgggtactataaaaagctcggcttcagcgaacaaggcggggtctacgacataccgccggtcggacctcatattttgatgtataagaaattgacgtaa

SEQ ID NO: 166 - DNA, 441 bp, Artificial Sequence
  Synthetic nucleic acid sequence
  7_2D7
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctgatcagcatcgcctcctttcatcaagccgaacatccagagcttgaaggccaaaaacagtatcagctgagagggatggcgacgcttgaagggtaccgtgagcaaaaagcgggaagtacgctcatccgccatgccgaagagcttcttcggaaaaaaggcgcggaccttttatggtgcaacgccaggacatctgcgagtgggtactataaaaagctcggcttcagcgaacagggcgaagtctacgacataccgccggtcggacctcatattttgatgtataagaaattgacgtaa

SEQ ID NO: 167 - DNA, 441 bp, Artificial Sequence
  Synthetic nucleic acid sequence
  7_5C7
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcctcctttcatcaagccgaacatccagagcttgaaggccaaaaacagtatcagctgagagggatggcgacacttgaaggataccgtgagcaaaaagtgggaagcacgctcatccgccatgccgaagagcttcttcggaaaaaaggcgcggaccttttatggtgcaacgccaggacatctgcgagcgggtactataaaaagctcggcttcagcgaacaaggcggggtctacgatataccgccggtcggacctcatattttgatgtataagaaattgacgtaa

SEQ ID NO: 168 - DNA, 441 bp, Artificial Sequence
  Synthetic nucleic acid sequence
  7_9C9
atgattgaagtcaaaccaataaacgcggaagatacgtatgaaatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagggtaccgcgagcaaaaagcgggaagtacgctcatccgccatgccgaagagcttctacggaaaaaaggcgcggaccttttatggtgcaacgccaggacatctgcgagcgggtactataaaaagctcggcttcagcgaacagggcgaagtctacgacataccgccgatcggacctcatattttgatgtataagaaattgacgtaa

SEQ ID NO: 169 - DNA, 441 bp, Artificial Sequence
  Synthetic nucleic acid sequence
  9_13F10
atgattgaagtcaaaccaataaacgcggaggatacgtatgagatcaggcaccgcattctccggccgaatcagccgctggaagcatgcaagtatgaaaccgatttgctcaggggtgcgtttcaccttggtggatattaccggggcaagctggtcagcatcgcctcctttcatcaagccgaacattcagagcttgaaggccaaaaacagtatcagctgagagggatggcgacacttgaagagtaccgcgagcaaaaagcgggaagcacgctcatccgccatgccgaagagcttcttcggaaaaagggggcagacctcttatggtgcaacgccaggacatctgcgagcgggtactataaaaagctcggcttcagcgaacagggcgaagtctacgacataccgccgactgggccccatattttgatgtataagaaattgacgtaa

SEQ ID NO: 170 - DNA, 441 bp, Artificial Sequence; identical to SEQ ID NO: 169
  Synthetic nucleic acid sequence
  9_13F1

SEQ ID NO: 171 - DNA, 441 bp, Artificial Sequence
  Synthetic nucleic acid sequence
  9_15D5
atgattgaagtcaaaccaataaacgcggaagatacgtatgagatcaggcaccgcattctccggccgaatcagccgctggacgcatgcaagtatgaaaccgatttgctcgggggcacgtttcacctcggtggatattaccggggcaagctgatcagcatcgcctcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaagggggcagacctcttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 172 - DNA, 441 bp, Artificial Sequence
  Synthetic nucleic acid sequence
  9_15D8
atgattgaagtcaaaccaataaacgcggaagatacgtatgagatcaggcaccgcatactccggccgaatcagccgcttgaagcatgtatgtatgaaaccgatttgctcgggggtacgtttcacctcggcggatattaccggggcaagctggtcagcatcgcctcctttcatcaagctgaacatccagagcttgaaggccaaaaacagtatcagctgagagggatggcgacacttgaagggtaccgtgagcaaaaagcgggcagtacgcttatccgccatgccgaagcgcttcttcggaagaaaggcgcggaccttttatggtgcaacgccaggacatctgcgagcgggtactataaaaagctcggcttcagcgaacagggcgaagtctacgacacaccgccggtcggaccccatattttgatgtataagaagttgacgtaa

SEQ ID NO: 173 - DNA, 441 bp, Artificial Sequence
  Synthetic nucleic acid sequence
  9_15H3
atgattgaagtcaagccaataaacgcggaagatacgtatgagatcaggcaccgcattctccggccgaatcagccgcttgaagcatgtatgtatgaaaccgatatgctcaggggtgcgtttcacctcggtggatattaccggggcaagctgatcagcatcgcctcctttcatcaagccgaacatccagagcttgaaggccaaaaacagtatcagctgagagggatggcgacacttgaagagtaccacgagcaaaaagcgggaagcacgctcatccgccatgccgaagagcttcttcggaaaaaaggcgcggaccttttatggtgcaacgccaggacatctgcgagcgggtactataaaaagctcggctttagcgaacagggcgaagtctacaacacaccgccggttggacctcatattttgatgtataagaaattgacgtaa

SEQ ID NO: 174 - DNA, 441 bp, Artificial Sequence
  Synthetic nucleic acid sequence
  9_18H2
atgattgaagtcaaaccaataaacgcggaagatacgtatgagatcaggcaccgcattctccggccgaatcagccgctggaagcatgtatgtatgaaaccgatttgctcgggggcacgtttcacctcggcggatattaccggggcaagctgatcagcatcgcctcctttcatcaagccgaacatccagagcttgtaggccaaaaacagtatcagctgagagggatggcgacacttgaaggataccgtgagcaaaaagcgggcagtacacttatccgccatgccgaagagcttcttcggaaaaagggggcagaccttttatggtgcaacgccaggacatctgcgagcgggtactataaaaagctcggcttcagcgaacagggcgaagtctacgacataccgccggtcggacctcatattttgatgtataagaaattgacgtaa

SEQ ID NO: 175 - DNA, 441 bp, Artificial Sequence
  Synthetic nucleic acid sequence
  9_20F12
atgattgaagtaaaaccaataaacgcggaagatacgtatgagatcaggcaccgcgttctccggccgaatcagccgctggaagcatgtatgtatgaaaccgatttgctcgggggcacgtttcacctcggtggatattaccggggcgagctggtcagcatcgcttcctttcatcaagccgaacatccagagcttgaaggccaaaaacagtatcagctgagagggatggcgacacttgaagggtaccgtgagcaaaaagcgggcagtacgcttatccgccatgccgaagagcttcttcggaaaaaaggcgcggaccttttgtggtgcaacgccaggacatctgcgagcgggtactataaaaagctcggcttcagcgaacaaggcggggtctacgacataccgccggtcggacctcatattttgatgtataagaaattgacgtaa

SEQ ID NO: 176 - DNA, 441 bp, Artificial Sequence
  Synthetic nucleic acid sequence
  9_21C8
atgattgaagtcaaaccaataaacgcggaagatacgtatgagatcaggcaccgcattctccggccgaatcagccgctggaagcatgtatgtatgaaactgatttgctcgggggcacgtttcacctcggcggatattaccggggcaagctgatcagcatcgcctcctttcatcaagccgaacatccagagcttgaaggccaaaaacagtatcagctgagagggatggcgacactcgaaggataccgcgagcaaaaagcgggcagtacgctaatccgccatgccgaagagcttcttcggaaaaagggggcagacctcttatggtgcaacgccaggacatctgcgagcgggtactataaaaagctcggcttcagcgatcagggcgaagtctacgacataccgccggtcggacctcatattttgatgtataagaaattgacgtaa

SEQ ID NO: 177 - DNA, 441 bp, Artificial Sequence
  Synthetic nucleic acid sequence
  9_22B1
atgattgaagtcaaaccaataaacgcggaagatacgtatgagataaggcaccgcatcctccggccgaatcagccgctggaagcatgcaagtatgaaaccgatttgctcgggggcacgtttcacctcggtggatattaccggggcaagctggtcagcatcgcctcctttcatcaagccgaacatccagagcttgaaggccaaaaacagtatcagctgagagggatggcgacacttgaagggtaccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacttaccgccgaccggaccccatattttgatgtataagaaattgacgtaa

SEQ ID NO: 178 - DNA, 441 bp, Artificial Sequence
  Synthetic nucleic acid sequence
  9_23A10
atgattgaagtcaaaccaataaacgcggaagatacgtatgagatcaggcaccgcattctccggccgaatcagccgctggaagcatgcaagtatgaaaccgatttgctcgggggcacgcttcacctcggtggatattaccggggcaagctggtcagcattgcttcctttcatcaagccgaacatccagagcttgagggccaaaaacagtatcagctgagagggatggcgacacttgaagggtaccgcgggcaaaaagcgggcagtacgcttatccgccatgccgaagagcttcttcggaaaaagggggcagaccttttatggtgcaatgccaggacatctgcgagcgggtactataaaaagctcggcttcagcgaacaaggcggggtctacgacataccgccggtcggacctcatattttgatgtataagaaattgacgtaa

SEQ ID NO: 179 - DNA, 441 bp, Artificial Sequence
  Synthetic nucleic acid sequence
  9_24F6
atgattgaagtcaaaccaataaacgcggaagatacgtatgagatcaggcaccgcattctcaggccgaatcagccgctagaagcatgcaagtatgaaaccgatttgctcaggggtgcgtttcacctcggtggatattaccggggcaagctgatcagcatcgcctcctttcatcaagccgaacattcagagcttgaaggccaaaaacagtatcagctgagagggatggcgacacttgaaggataccgtgagcaaaaagcgggcagtacgcttatccgccatgccgaagcgcttcttcggaaaaaaggcgcggaccttttgtggtgcaacgccaggacgtctgcgagcgggtactataaaaagctcggcttcagcgaacagggcgaagtctacgacataccgccgaccggaccccatattttgatgtataagaaattgacgtaa

SEQ ID NO: 180 - DNA, 441 bp, Artificial Sequence
  Synthetic nucleic acid sequence
  9_4H10
atgattgaagtcaaaccaataaacgcggaagatacgtatgagatcaggcaccgcattctccggccgaatcagccgctggaagcatgcaagtatgaaactgatttgctagggggtacgcttcacctcggtggatattaccggggcaagctgatcagcatcgcctcctttcatcaagccgaacatccagagcttgaaggccaaaaacagtatcagctgagagggatggcgacacttgaagggtaccgtgagcaaaaagcgggcagtacgcttatccgccatgccgaagagcttcttcggaaaaagggcgcggaccttatatggtgcaacgccaggacatctgcgagcgggtactataaaaagctcggcttcagcgaacagggcgaagtctacgacataccgccggtcggacctcatattttgatgtataagaaattgacataa

SEQ ID NO: 181 - DNA, 441 bp, Artificial Sequence
  Synthetic nucleic acid sequence
  9_4H8
atgattgaagtcaaaccaataaatgcggaagatacgtatgagatcaggcaccgcattctccggccgaatcagccgcttgaagcatgtatgtatgaaaccgatttgctcggaggcacgtttcacctaggtggatattaccggggcaagctgatcagcatcgcttcctttaatcaagccgaacatccagagcttgaaggccaaaaacagtatcagctgagagggatggcgacacttgaagggtaccgtgagcaaaaagcgggcagtacgcttatccgccatgccgaagagcttcttcggaaaaagggggcagaccttttatggtgcaacgccaggacatctgcgagcgggtactataaaaagctcggcttcagcgaacagggcgaagtctacgacataccgccggtcggacctcatattttgatgtataagaaattgacataa

SEQ ID NO: 182 - DNA, 441 bp, Artificial Sequence
  Synthetic nucleic acid sequence
  9_8H1
atgattgaagtcaaaccaataaccgcggaagatacgtatgagatcaggcaccgcattctccggccgaatcagccgctggaagcatgcaagtatgaaaccgatttgctcgggggtacgtttcacctcggtggatattaccggggcaagctgatcagcatcgcctcctttcatcaagccgaacatccagagcttgaaggccaaaaacagtatcagctgagagggatggcgacactagaagggtaccgcgagcaaaaagcgggcagtacgctcatccgccatgccgaagagcttcttcggaaaaagggggcagaccttttatggtgcaacgccagaacatctgcgagcgggtactataaaaagctcggcttcagcgaacagggcgaagtctacgacataccgccgaccggaccccatattttgatgtataagaaattgacgtaa

SEQ ID NO: 183 - DNA, 441 bp, Artificial Sequence
  Synthetic nucleic acid sequence
  9_9H7
atgattgaagtcaaaccaataaacgcggaagatgcgtatgagatcaggcaccgcattctccggccgaatcagccgctggaagcatgcaagtatgaaaccgatttgctcgggagcacgtttcacctcggtggatattaccggggcaagctgatcagcatcgcctcctttcatcaagccgaacatccagagcttgaaggccaaaaacagtatcagctgagagggatggcgacacttgaagagtaccgcgagcaaaaagcgggaagtacgcttatccgccatgccgaagagcttcttcggaaaaaaggcgcggaccttttatggtgcaacgccaggacatctgcgagcgggtactataaaaagctcggcttcagcgaacagggcgaagtctacgacataccgcctgtcggacctcatattttgatgtataagaaattgacgtaa

SEQ ID NO: 184 - DNA, 441 bp, Artificial Sequence; identical to SEQ ID NO: 93
  Synthetic nucleic acid sequence
  9C6

SEQ ID NO: 185 - DNA, 441 bp, Artificial Sequence
  Synthetic nucleic acid sequence
  9H11
atgattgaagtcaaaccaataaacgcggaagatacgtatgagatcaggcaccgcattctccggccgaatcagccgttggaagcatgcaagtatgaaaccgatttgctcgggggtacgtttcacctcggcggatattaccggggcaagctgatcagcatcgcttcctttcataaagccgaacattcagagcttgagggcgaagaacagtatcagctgagagggatggcgacgcttgaaggataccgtgagcaaaaagcgggaagcacgctcatccgccatgccgaagagcttcttcggaaaaagggggcagaccttttatggtgcaatgccaggacatctgtgagcgggtactataaaaagctcggcttcagcgaacagggcgaagtctacgacataccgccgatcggacctcatattttgatgtataagaaattgacgtaa

SEQ ID NO: 186 - DNA, 441 bp, Artificial Sequence
  Synthetic nucleic acid sequence
  0_4B10
atgatagaagtgaaaccgattaacgcagaggatacctatgaactaaggcataaaatactcagaccaaaccagccgatagaagcgtgtatgtatgaaagcgatttacttcgtggtgcatttcacttaggcggcttttacaggggcaaactgatttccatagcttcattccaccaggccgagcactcagacctcgaaggccagaaacagtaccagctccgaggtatggctaccttggaaggttatcgtgatcagaaagcgggatcgactctaattaaacacgctgaagaaattcttcgtaagaggggggcggacatgctttggtgcaatgcgcggacaaccgcctcaggctactacaaaaagttaggcttcagcgagcagggagagatatttgatacgccgccagtaggacctcacatcctgatgtataaaaggctcacataa

SEQ ID NO: 187 - DNA, 438 bp, Artificial Sequence
  Synthetic nucleic acid sequence
  0_5B11
atgatagaggtgaaaccgattaacgcagaggatacctatgaactaaggcataaaatactcagaccaaaccagccgatagaagcgtgtatgtatgaaagcgatttacttcgtggtgcatttcacttaggcggcttttacgggggcaaactgatttccatagcttcattccaccaggccgagcactcagacctcgaaggccagaaacagtaccagctccgaggtatggctaccttggaaggttatcgtgatcagaaagcgggatcgactctaattaaacacgctgaacaacttcttcgtaagaggggggcggacatgctttggtgcaatgcgcggacatccgcctcaggctactacaaaaagttaggcttcagcgagcagggagaggtatttgaaacgccgccagtaggacctcacatcctgatgtataaaaagatcaca

SEQ ID NO: 188 - DNA, 438 bp, Artificial Sequence
  Synthetic nucleic acid sequence
  0_5B3
atgctagaggtgaaaccgattaacgcagaggatacctatgaactaaggcatagaatactcagaccaaaccagccgatagaagcgtgtatgtatgaaaccgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgatcagaaagcgggatcgagtctaattaaacacgctgaacaacttcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcaca

SEQ ID NO: 189 - DNA, 438 bp, Artificial Sequence
  Synthetic nucleic acid sequence
  0_5B4
atgctagaggtgaaactgattaacgcagaggatacctatgaactaaggcatagaatactcagaccaaaccagccgttagaagcgtgtatgtatgaaaccgatttacttcgtggtgcatttcacttaggcggcttttacaggggcaaactgatttccatagcttcattccaccaggccgagcactcagacctcgaaggccagaaacagtaccagctccgaggtatggctaccttggaaggttttcgtgatcagaaagcgggatcgagtctaattaaacacgctgaagaaattcttcgtaagaggggggcgaacttgctttggtgtaatgcgcggacatccgcctcaggctactacaaaaagttaggcttcagcgagcagggagaggtatttgatacgccgccagtaggacctcacatcctgatgtataaaaggatcaca

SEQ ID NO: 190 - DNA, 438 bp, Artificial Sequence
  Synthetic nucleic acid sequence
  0_5B8
atgatagaggtgaaaccgattaacgcagaggatacctatgaactaaggcataaaatactcagaccaaaccagccgatagaagcgtgtatgtatgaaagcgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacttgctttggtgcaatgcgcggacatccgcctcaggctactacaaaaagttaggcttcagcgagcagggagagatatttgatacgccgccagtaggacctcacatcctgatgtataaaaggctcaca

SEQ ID NO: 191 - DNA, 438 bp, Artificial Sequence
  Synthetic nucleic acid sequence
  0_5C4
atgatagaggtgaaaccgattaacgcagaggatacctatgaactaaggcataaaatactcagaccaaaccagccgttagaagcgtgtatgtatgaaaccgatttacttcgtggtgcatttcacttaggcggcttttacaggggcaaactgatttccatagcttcattccaccaggccgagcactcaggcctccaaggccagaaacagtaccagctccgaggtatggctaccttggaaggttatcgtgagcagaaagcgggatcgagtataattaaacacgctgaagaaattcttcgtaagaagggggcggacttgctttggtgcaatgcgcggacgtccgcctcaggctactacaaaaagttaggcttcagcgagcagggagagatatttgacacgccgccagtaggacctcacatcctgatgtataaaaggatcaca

SEQ ID NO: 192 - DNA, 438 bp, Artificial Sequence
  Synthetic nucleic acid sequence
  0_5D11
atgatagaggtgaaaccgattaacgcagaggatacctatgaactaaggcatagaatactcagaccaaaccagccgatagaagcgtgtatgtatgaaagcgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgagcagaaagcgggatcgactctaattagacacgctgaacaacttcttcgtaagaggggggcggacttgctttggtgcaatgcgcggacatccgcctcaggctactacaaaaggttaggcttcagcgagcagggagaggtatttgatacgccgccagtaggacctcacatcctgatgtataaaaggctcaca

SEQ ID NO: 193 - DNA, 441 bp, Artificial Sequence
  Synthetic nucleic acid sequence
  0_5D3
atgctagaggtgaaaccgattaacgcagaggatacctatgaactaaggcatagaatactcagaccaaaccagccgatagaagcgtgtatgtatgaaagcgatttacttcgtggtgcatttcacttaggcggctattacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 194 - DNA, 438 bp, Artificial Sequence
  Synthetic nucleic acid sequence
  0_5D7
atgatagaagtgaaaccgattaacgcagaggagacctatgaactaaggcatagaatactcagaccaaaccagccgatagaagcgtgtatgtatgaaaccgatttacttcgtggtgcatttcacttaggcggcttttacaggggcaaactgatttccatagcttcattccaccaggccgagcactcagaactcgaaggccagaaacagtaccagctccgaggtatggctaccttggaaggttatcgtgatcagaaagcgggatcgagtctaattagacacgctgaacaacttcttcgtaagaagggggcgaatatgctttggtgtaatgcgcggacaaccgcctcaggctactacaaaaagttaggcttcagcgagcagggagagatatttgatacgccgccagtaggacctcacatcctgatgtataaaaggatcaca

SEQ ID NO: 195 - DNA, 438 bp, Artificial Sequence
  Synthetic nucleic acid sequence
  0_6B4
atgctagaggtgaaaccgattaacgcagaggatacctatgaactaaggcatagaatactcagaccaaaccagccgatagaagcgtgtatgtatgaaagcgatttacttcgtggtgcacttcacttaggcggcttttacaggggcaaactgatttccatagcttcattccaccaggccgagcactcagacctccaaggccagaaacagtaccagctccgaggtatggctaccttggaaggttttcgtgatcagaaagcgggatcgagtctaattagacacgctgaacaaattcttcgtaagaggggggcggacttgctttggtgcaatgcgcggacatccgcctcaggctactacaaaaagttaggcttcagcgagcagggaaaggtatttgatacgccgccagtaggacctcacatcctgatgtataaaaggatcaca

SEQ ID NO: 196 - DNA, 438 bp, Artificial Sequence
  Synthetic nucleic acid sequence
  0_6D10
atgctagaggtgaaaccgattaacgcagaggatacctatgaactaaggcataaaatactcagaccaaaccagccgttagaagtgtgtatgtatgaaaccgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacaaaaagttaggcttcagcgagcagggagaggtatttgaaacgccgccagtaggacctcacatcctgatgtataaaaggctcaca

SEQ ID NO: 197 - DNA, 441 bp, Artificial Sequence; identical to SEQ ID NO: 29
  Synthetic nucleic acid sequence
  0_6D11

SEQ ID NO: 198 - DNA, 438 bp, Artificial Sequence
  Synthetic nucleic acid sequence
  0_6F2
atgatagaggtgaaaccgattaacgcagaggatacctatgaactaaggcatagaatactcagaccaaaccagccgatagaagcgtgtatgtatgaaagcgatttacttcgtggtgcatttcacttaggcggctattacaggggcaaactgatttccatagcttcattccaccaggccgagcactcagaactccaaggccagaaacagtaccagctccgaggtatggctaccttggaaggttttcgtgagcagaaagcgggatcgactctaattagacacgctgaacaaattcttcgtaagaggggggcggacatgctttggtgcaatgcgcggacatccgcctcaggctactacaaaaagttaggcttcagcgagcagggagagatatttgatacgccgccagtaggacctcacatcctgatgtataaaaggatcaca

SEQ ID NO: 199 - DNA, 438 bp, Artificial Sequence
  Synthetic nucleic acid sequence
  0_6H9
atgatagaggtgaaaccgattaacgcagaggatacctatgaactaaggcataaaatactcagaccaaaccagccgatagaagcgtgtatgtatgaaaccgatttacttcgtggtgcatttcacttaggcggcttttacgggggcaaactgatttccatagcttcattccaccaggccgagcactcagacctcgaaggccagaaacagtaccagctccgaggtatggctaccttggaaggttatcgtgagcagaaagcgggatcgactctaattagacacgctgaagaaattcttcgtaagaagggggcgaacttgctttggtgcaatgcgcggacatccgcctcaggctactacaaaaagttaggcttcagcgagcagggagaggtatttgacacgccgccagtaggacctcacatcctgatgtataaaaggctcaca

SEQ ID NO: 200 - DNA, 441 bp, Artificial Sequence
  Synthetic nucleic acid sequence
  10_4C10
  misc_feature 134, 313: n = A,T,C or G
atgatagaggtgaaaccgattaacgcagaggatacctatgaactaaggcataaaatactcagaccaaaccagccgttagaagtgtgtatgtatgaaaccgatttacttcgtggtgcatttcacttaggcggctnttacaggggcaaactgatttccatagcttcattccaccaggccgagcactcagaactccaaggccagaaacagtaccagctccgaggtatggctaccttggaaggttatcgtgatcagaaagcgggatcgagtctaattaaacacgctgaacaaattcttcgtaagaggggggcggacntgctttggtgcaatgcgcggacatccgcctcaggctactacaaaaagttaggcttcagcgagcagggagagatatttgatacgccgccagtaggacctcacatcctgatgtataaaaggctcacataa

SEQ ID NO: 201 - DNA, 441 bp, Artificial Sequence
  Synthetic nucleic acid sequence
  10_4D5
atgatagaggtgaaaccgattaacgcagaggatacctatgaactaaggcatagaatactcagaccaaaccagccgatagaagtgtgtatgtatgaaaccgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgagcagaaagcgggatcgactctaattagacacgctgaacaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 202 - DNA, 441 bp, Artificial Sequence
  Synthetic nucleic acid sequence
  10_4F2
atgctagaggtgaaaccgattaacgcagaggatacctatgaactaaggcatagaatactcagaccaaaccagccgatagaagcgtgtatgtttgaaagcgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattagacacgctgaagaaattcttcgtaagaggggggcggacatgctttggtgtaatgcgcggacatccgcctcaggctactacaaaaagttaggcttcagcgagcagggagagatatttgaaacgccgccagtaggacctcacatcctgatgtataaaaggctcacataa

SEQ ID NO: 203 - DNA, 441 bp, Artificial Sequence
  Synthetic nucleic acid sequence
  10_4F9
atgatagaggtgaaaccgattaacgcagaggatacctatgaactaaggcatagaatactcagaccaaaccagccgatagaagtgtgtatgtatgaaaccgatttacttcgtggtgcatttcacttaggcggcttttacaggggcaaactgatttccatagcttcattccaccaggccgagcactcagaactccaaggccagaaacagtaccagctccgaggtatggctaccttggaaggttttcgtgagcagaaagcgggatcgagtctaattagacacgctgaacaaattcttcgtaagaggggggcggacttgctttggtgtaatgcgcggacatccgcctcaggctactacaaaaagttaggcttcagcgagcagggagagatatttgatacgccgccagtaggacctcacatcctgatgtataaaaggctcacataa

SEQ ID NO: 204 - DNA, 441 bp, Artificial Sequence
  Synthetic nucleic acid sequence
  10_4G5
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcttcattccaccaggccgagcactcagacctccaaggccagaaacagtaccagctccgaggtatggctaccttggaaggttaccgcgatcagaaagcgggatcgagtctaattagacacgctgaacaaattcttcgtaagaggggggcggacttgctttggtgtaatgcgcggacatccgcctcaggctactacaaaaagttaggcttcagcgagcagggagagatatttgatacgccgccagtaggacctcacatcctgatgtataaaaggctcacataa

SEQ ID NO: 205 - DNA, 441 bp, Artificial Sequence
  Synthetic nucleic acid sequence
  10_4H4
atgctagaggtgaaaccgattaacgcagaggatacctatgaactaaggcataaaatactcagaccaaaccagccgttagaagtgtgtatgtatgaaaccgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 206 - DNA, 441 bp, Artificial Sequence
  Synthetic nucleic acid sequence
  11_3A11
atgatagaagtgaaaccgattaacgcagaggatacctatgaactgaggcataaaatactcagaccaaaccagccgatagaagtgtgtatgtatgaaagcgatttacttcgtggtgcatttcacttaggcggcttttacaggggcaaactgatttccatagcgtcattccaccaggccgagcacccagacctccaaggccagaaacagtaccagctccgaggtatggctaccttggaaggttatcgtgatcagaaagcgggatcgagtctaattaaacacgctgaacaaattcttcgtaagaggggggcggacttgctttggtgcaatgcgcggacatccgcctcaggctactacaaaaagttaggcttcagcgagcagggagaggtatttgaaacgccgccagtaggacctcacatcctgatgtataaaaggctcacataa

SEQ ID NO: 207 - DNA, 441 bp, Artificial Sequence
  Synthetic nucleic acid sequence
  11_3B1
atgctagaggtgaaaccgattaacgcagaggatacctatgaactgaggcatagaatactcagaccaaaccagccgatagaagcgtgtatgtttgaaaccgatttacttcgtggtgcatttcacttaggcggcttttacaggggcaaactgatttccatagcttcattccaccaggccgagcactcagacctccaaggccagaaacagtaccaactccgaggtatggctaccttggaaggttttcgtgagcagaaagcgggatcgactctaattagacacgctgaagaaattcttcgtaagaggggggcggacttgctttggtgcaatgcgcggacatccgcctcaggctactacaaaaggttaggcttcagcgagcagggagagatatttgacacgccgccagtagggcctcacatcctgatgtataaaaggctcacataa

SEQ ID NO: 208 - DNA, 441 bp, Artificial Sequence
  Synthetic nucleic acid sequence
  11_3B5
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcgtcattccaccaggccgagcactcggaactccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 209 - DNA, 441 bp, Artificial Sequence
  Synthetic nucleic acid sequence
  11_3C12
atgatagaggtgaaaccgattaacgcagaggatacctatgaactaaggcatagaatactcagaccaaaccagccgttagaagtgtgtatgtatgaaaccgatttacttcgtggtgcatttcacttgggcggcttttacgggggcaaactgatttccatagcgtcattccaccaggccgagcacccagacctccaaggccagaaacagtaccagctccgaggtatggctaccttggaaggttatcgtgatcagaaagcgggatcgagtctaattagacacgctgaacaacttcttcgtaagaggggggcggacttgctttggtgcaatgcgcggacatccgcctcaggctactacaaaaagttaggcttcagcgagcagggagagatattcgaaacgccgccagtaggacctcacatcctgatgtataaaaggatcacataa

SEQ ID NO: 210 - DNA, 441 bp, Artificial Sequence
  Synthetic nucleic acid sequence
  11_3C3
atgatagaagtgaaaccgattaacgcagaggatacctatgaactaaggcataaaatactcagaccaaaccagccgatagaagcgtgtatgtatgaaagcgatttacttcgtggtgcacttcacttaggcggctattacaggggcaaactgatttccatagcgtcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgacacgccgccagtaggacctcacatcctgatgtataaaaggatcacataa

SEQ ID NO: 211 - DNA, 441 bp, Artificial Sequence
  Synthetic nucleic acid sequence
  11_3C6
atgctagaggtgaaaccgattaacgcagaggatacctatgaactaaggcataaaatactcagaccaaaccagccgatagaagcgtgtatgtttgaaagcgatttacttcgtggtgcatttcacttaggcggcttttacgggggcaaactgatttccatagcttcattccaccaggccgagcactcagacctcgaaggccagaaacagtaccagctccgaggtatggctaccttggaaggttatcgtgagcagaaagcgggatcgactctaattagacacgctgaagaaattcttcgtaagaggggggcggacttgctttggtgcaatgcgcggacatccgcctcaggctactacaaaaagttaggcttcagcgagcagggagagatatttgatacgccgccagtaggacctcacatcctgatgtataaaaggatcacataa

SEQ ID NO: 212 - DNA, 441 bp, Artificial Sequence
  Synthetic nucleic acid sequence
  11_3D6
atgatagaggtgaaaccgattaacgcagaggatacctatgaactaaggcatagaatactcagaccaaaccagccgatagaagtgtgtatgtatgaaaccgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgagcagaaagcgggatcgagtctaattaaacacgctgaacaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggctcacataa

SEQ ID NO: 213 - DNA, 441 bp, Artificial Sequence
  Synthetic nucleic acid sequence
  1_1G12
atgctagaggtgaaaccgattaacgcagaggatacctatgaactaaggcatagaatactcagaccaaaccagccgatagaagtgtgtatgtatgaaaccgatttacttcgtggtgcatttcacttaggcggcttttacgggggcaaactgatttccatagcttcattccaccaggccgagcactcagaactccaaggccagaaacagtaccagctccgaggtatggctaccttggaaggttatcgtgatcagaaagcgggatcgagtctaattaaacacgctgaagaaattcttcgtaagaggggggcggacttgctttggtgtaatgcgcggacatccgcctcaggctactacaaaaagttaggcttcagcgagcagggagaggtatttgaaacgccgccagtaggacctcacatcctgatgtataaaaggctcacataa

SEQ ID NO: 214 - DNA, 438 bp, Artificial Sequence
  Synthetic nucleic acid sequence
  1_1H1
atgatagaagtgaaacctattaacgcagaggagacttacgaacttcgacacaagatcctgcgccctaatcagccgatagaggcatgcatgtatgaaagcgatctgctgcggggctcgttccatttgggcgggttctatcgtggccaattgatctcgattgcgagtttccacaaagctgaacactcagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataaaaggcttggttttagtgagcacggcgaagttttcgaaaccccgccggttgggccgcacattcttatgtacaaaagaatcact

SEQ ID NO: 215 - DNA, 438 bp, Artificial Sequence
  Synthetic nucleic acid sequence
  1_1H2
atgatagaagtgaaacctattaacgcagaggatacttacgaacttcgacacaggatcctgcgccctaatcagccgttagaggcatgcatgtatgaaagcgatctgctgcggggctcgttccatttgggcgggttctatcgtggcaaattgatctcgattgcgagtttccaccaagctgaacactcagaactggaagggcaaaagcagtatcaattacgagggatggcgaccctcgaaggattccgtgagcagaaggctggctcttcgcttattaggcacgccgaggagatactacggaaaagaggggcagatctgctttggtgtaatgcacgcacgacagccgccggttactataaaaagcttggttttagtgagcagggcgaaattttcgacaccccgccggttgggccgcacattcttatgtacaaaagaatcact

SEQ ID NO: 216 - DNA, 438 bp, Artificial Sequence
  Synthetic nucleic acid sequence
  1_1H5
atgatagaagtgaaacctattaacgcagaggatacttacgaaattcgacacaggatcctgcgccctaatcagccgttagaggcatgcatgtatgaaagcgatctgctgcggggctcgttccatttgggcgggttctatcgtggcaaattgatctcgattgcgagtttccaccaagctgaacactcagacctggaagggcaaaagcagtatcaattacgagggatggcgaccctcgaaggataccgtgatcagaaggctggctcttcgcttattaggcacgccgagcagatactacggaaaagaggggcagatctgctttggtgcaatgcacgcacgacagccgccggttactataaaaggcttggttttagtgagcagggcgaagttttcgacaccccgccggttgggccgcacattcttatgtacaaaaaactcact

SEQ ID NO: 217 - DNA, 438 bp, Artificial Sequence
  Synthetic nucleic acid sequence
  1_2A12
atgatagaagtgaaacctattaacgcagaggatacttacgaacttcgacacaggatcctgcgccctaatcagccgatagaggcatgcatgtatgaaagcgatctgctgcggggctcgttccatttgggcgggttctatcgtggcaaattgatctcgattgcgagtttccaccaagctgaacagtcagaactggaagggcaaaagcagtatcaattacgagggatggcgaccctcgaaggataccgtgatcagaaggctggctctacgcttattaagcacgccgaggagatactacggaaaaaaggggcagatctgctttggtgcaatgcacgcacgtcagccgccggttactataaaaggcttggttttagtgagcagggcgaaattttcgacaccccgccggttgggccgcacattcttatgtacaaaagactcact

SEQ ID NO: 218 - DNA, 438 bp, Artificial Sequence
  Synthetic nucleic acid sequence
  1_2B6
atgatagaagtgaaacctattaacgcagaggagacttacgaacttcgacacaagatcctgcgccctaatcagccgttagaggcatgcatgtatgaaaccgatctgctgcggggctcgttccatttgggcgggttctatcgtggcaaattgatctcgattgcgagtttccaccaagctgaacactcagaactggaagggcaaaagcagtatcaattacgagggatggcgaccctcgaaggattccgtgatcagaaggctggctcttcgcttattaagcacgccgaggagatactacggaaaagaggggcagatctgctttggtgcaatgcacgcacgtcagcctccggttactataaaaagcttggttttagtgagcagggcgaaattttcgaaaccccgccggttgggccgcacattcttatgtacaaaagactcact

SEQ ID NO: 219 - DNA, 438 bp, Artificial Sequence
  Synthetic nucleic acid sequence
  1_2C4
atgctagaagtgaaacctattaacgcagaggagacttacgaacttcgacacaagatcctgcgccctaatcagccgatagaggcatgcatgtatgaaaccgatctgctgcggggctcgttccatttgggcgggttctatcgtggccaattgatctcgattgcgagtttccaccaagctgaacactcagacctgcaagggcaaaagcagtatcaattacgagggatggcgaccctcgaaggataccgtgagcagaaggctggctctacgcttattaagcacgccgaggagctactacggaaaaaaggggcagatctgctttggtgcaatgcacgcacgacagccgccggttactataaaaagcttggttttagtgagcagggcgaagttttcgacaccccgccggttgggccgcacattcttatgtacaaaaaaatcact

SEQ ID NO: 220 - DNA, 441 bp, Artificial Sequence
  Synthetic nucleic acid sequence
  1_2D2
atgatagaagtgaaacctattaacgcagaggatacttacgaacttcgacacaagatcctgcgccctaatcagccgttagaggcatgcatgtatgaaagcgatctgctgcggagcgcattccatttgggcgggttctatcgtggcaaattgatctcgattgcgagtttccacaaagctgaacactcagaactgcaagggcaaaagcagtatcaattacgagggatggcgaccctcgaaggataccgtgatcagaaggctggctcttcgcttattaggcacgccgaggagatactacggaaaagaggggcagatatgctttggtgcaatgcacgcacgtcagccgccggttactataaaaggcttggttttagtgagcagggcgaagttttcgacaccccgccggttgggccgcacattcttatgtacaaaagaatcacttaa

SEQ ID NO: 221 - DNA, 438 bp, Artificial Sequence
  Synthetic nucleic acid sequence
  1_2D4
atgatagaagtgaaacctattaacgcagaggatacttacgaacttcgacacaggatcctgcgccctaatcagccgatagaggcatgcatgtatgaaagcgatctgctgcggggctcgttccatttgggcgggttctatcgtggcaaattgatctcgattgcgagtttccaccaagctgaacactcagacctgcaagggcaaaagcagtatcaattacgagggatggcgaccctcgaaggataccgtgagcagaaggctggctcttcgcttattaagcacgccgagcagctactacggaaaaaaggggcagatatgctttggtgtaatgcacgcacgtcagccgccggttactataaaaggcttggttttagtgagcacggcgaaattttcgaaaccccgccggttgggccgcacattcttatgtacaaaagaatcact

SEQ ID NO: 222 - DNA, 438 bp, Artificial Sequence
  Synthetic nucleic acid sequence
  1_2F8
atgctagaagtgaaacctattaacgcagaggatacttacgaacttcgacacaggatcctgcgccctaatcagccgttagaggcatgcatgtatgaaaccgatctgctgcggggctcgttccatttgggcgggttctatcgtggcaaattgatctcgattgcgagtttccaccaagctgaacattcagaactggaagggcaaaagcagtatcaattacgagggatggcgactctcgaaggataccgtgatcagaaggctggctcttcgcttattaggcacgccgaggagatactacggaaaagaggggcagatatgctttggtgcaatgcacgcacgacagccgccggttactataaaaagcttggttttagtgagcagggcgaaatttacgacaccccgccggttgggccgcacattcttatgtacaaaaaactcact

SEQ ID NO: 223 - DNA, 441 bp, Artificial Sequence
  Synthetic nucleic acid sequence
  1_2H8
atgatagaagtgaaacctattaacgcagaggagacttacgaacttcgacacaagatcctgcgccctaatcagccgttagaggcatgcatgtatgaaaccgatctgctgcggggcgcgttccatttgggcgggttctatcgtggcaaattgatctcgattgcgagtttccaccaagctgaccactcagaactgcaagggcaaaagcagtatcaattacgagggatggcgaccctcgaaggataccgtgagcagaaggctggctctacgcttattaggcacgccgagcagatactacggaaaagaggggcagatctactttggtgcaatgcacgcacgtcagccgccggttactataaaaagcttggttttagtgagcacggcgaaattttcgaaaccccgccggttgggccgcacattcttatgtacaaaagactcacttaa

SEQ ID NO: 224 - DNA, 438 bp, Artificial Sequence
  Synthetic nucleic acid sequence
  1_3A2
atgatagaagtgaaacctattaacgcagaggatacttacgaacttcgacacaggatcctgcgccctaatcagccgatagaggcatgcatgtatgaaagcgatctgctgcggggcgcgttccatttgggcgggttctatcgtggcaaattgatctcgattgcgagtttccaccaagctgaacactcagacctgcaagggcaaaagcagtatcaattacgagggatggcgaccctcgaaggataccgtgagcagaaggctggctcttcgcttattaggcacgccgaggagatactacggaaaaaaggggcagatatgctttggtgcaatgcacgcacgacagccgccggttactataaaaggcttggttttagtgagcagggcgaagttttcgacaccccgccggttgggccgcacattcttatgtacaaaagaatcact

SEQ ID NO: 225 - DNA, 441 bp, Artificial Sequence; identical to SEQ ID NO: 212
  Synthetic nucleic acid sequence
  1_3D6

SEQ ID NO: 226 - DNA, 438 bp, Artificial Sequence
  Synthetic nucleic acid sequence
  1_3F3
atgatagaagtgaaacctattaacgcagaggagacttacgaacttcgacagaggatcctgcgccctaatcagccgatagaggcatgcatgtatgaaagcgatctgctgcggggctcgttccatttgggcgggttctatcgtggccaattgatctcgattgcgagtttccaccaagctgaacactcagaactgcaagggcaaaagcagtatcaattacgagggatggcgaccctcgaaggataccgtgagcagaaggctggctctacgcttattaagcacgccgaggagatactacggaaaaaaggggcagatctgctttggtgcaatgcacgcacgtcagccgccggttactataaaaggcttggttttagtgagcacggcgaaattttcgacaccccgccggttgggccgcacattcttatgtacaaaagaatcact

SEQ ID NO: 227 - DNA, 438 bp, Artificial Sequence
  Synthetic nucleic acid sequence
  1_3H2
atgatagaagtgaaacctattaacgcagaggatacttacgaacttcgacacaggatcctgcgccctaatcagccgatagaggcatgcatgtatgaaaccgatctgctgcggggcgcgttccatttgggcgggtactatcgtggccaattgatctcgattgcgagtttccacaaagctgaacactcagaactgcaagggcaaaagcagtatcaattacgagggatggcgaccctcgaaggataccgtgagcagaaggctggctctacgcttattaagcacgccgagcagctactacgggaaaaaggggcagatatgctttggtgcaatgcacgcacgtcagccgccggttactataaaaggcttggttttagtgagcagggcgaagttttcgacaccccgccggttgggccgcacattcttatgtacaaaaaactcact

SEQ ID NO: 228 - DNA, 441 bp, Artificial Sequence
  Synthetic nucleic acid sequence
  1_4C5
atgatagaagtgaaacctattaacgcagaggatacttacgaacttcgacacaagatcctgcgccctaatcagccgatagaggcatgcatgtatgaaagcgatctgctgcggggctcgttccatttgggcgggttctatcgtggcaaattgatctcgattgcgagtttccacaaagctgaacactcagacctggaagggcaaaaccagtatcaattacgagggatggcgaccctcgaaggataccgtgagcagaaggctggctctacgcttattaggcacgccgaggagatactacggaaaagaggggcagatatgctttggtgcaatgcacgcacgtcagcctccggttactataaaaggcttggttttagtgagcacggcgaaattttcgacaccccgccggttgggccgcacattcttatgtacaaaagactcacttaa

SEQ ID NO: 229 - DNA, 438 bp, Artificial Sequence
  Synthetic nucleic acid sequence
  1_4D6
atgctagaagtgaaacctattaacgcagaggatacttacgaacttcgacacaggatcctgcgccctaatcagccgatagaggcatgcatgtatgaaaccgatctgctgcggggctcgttccatttgggcgggttctatcgtggccaattgatctcgattgcgagtttccacaaagctgaacactcagacctggaagggcaaaagcagtatcaattacgagggatggcgaccctcgaaggataccgtgagcagaaggctggctctacgcttattaggcacgccgagcagatactacggaaaagaggggcagatatgctctggtgcaatgcacgcacgtcagccgccggttactataaaaggcttggttttagtgagcagggcgaagttttcgaaaccccgccggttgggccgcacattcttatgtacaaaagactcact

SEQ ID NO: 230 - DNA, 438 bp, Artificial Sequence
  Synthetic nucleic acid sequence
  1_4H1
atgatagaagtgaaacctattaacgcagaggatacttacgaacttcgacacaggatcctgcgccctaatcagccgttagaggcatgcatgtatgaaaccgatctgctgcggggctcgttccatttgggcgggttctatcgtggcaaattgatctcgattgcgagtttccaccaagctgaacactcagacctgcaagggcaaaagcagtatcaattacgagggatggcgaccctcgaaggataccgtgagcagaaggctggctctacgcttattaggcacgccgagcagctactacggaaaagaggggcagatctgctttggtgcaatgcacgcacgtcagcctccggttactataaaaggcttggttttagtgagcacggcgaagttttcgacaccccgccggttgggccgcacattcttatgtacaaaagactcact

SEQ ID NO: 231 - DNA, 441 bp, Artificial Sequence
  Synthetic nucleic acid sequence
  1_5H5
atgctagaagtgaaacctattaacgcagaggagacttacgaacttcgacacaagatcctgcgccctaatcagccgttagaggcatgcatgtatgaaagcgatctgctgcggggctcgttccatttgggcgggtactatcgtggccaattgatctcgattgcgagtttccaccaagctgaacactcagaactggaagggcaaaagcagtatcaattacgagggatggcgaccctcgaaggattccgtgagcagaaggctggctctacgcttattaagcacgccgagcagatactacggaaaagaggggcagatatgctttggtgcaatgcacgcacgtcagccgccggttactataaaaagcttggttttagtgagcacggcgaaattttcgacaccccgccggttgggccgcacattcttatgtacaaaaaactcacttaa

SEQ ID NO: 232 - DNA, 438 bp, Artificial Sequence
  Synthetic nucleic acid sequence
  1_6F12
atgatagaagtgaaacctattaacgcagaggagacttacgaacttcgacacaggatcctgcgccctaatcagccgatagaggcatgcatgtatgaaagcgatctgctgcggggctcgttccatttgggcgggttctatcgtggcaaattgatctcgattgcgagtttccaccaagctgaacactcagacctagaagggcaaaagcagtatcaattacgagggatggcgaccctcgaaggataccgtgatcagaaggctggctctacgcttattaagcacgccgaggagctactacggaaaagaggggcagatatgctttggtgcaatgcacgcacgtcagccgccggttactataaaaggcttggttttagtgagcacggcgaaatttacgaaaccccgccggttgggccgcacattcttatgtacaaaaaaatcact

SEQ ID NO: 233 - DNA, 438 bp, Artificial Sequence
  Synthetic nucleic acid sequence
  1_6H6
atgatagaagtgaaacctattaacgcagaggatacttacgaacttcgacacaagatcctgcgccctaatcagccgatagaggcatgcatgtatgaaagcgatctgctgcggggctcgttccatttgggcgggttctatcgtggccaattgatctcgattgcgagtttccaccaagctgaacactcagacctggaagggcaaaagcagtatcaattacgagggatggcgaccctcgaaggataccgtgatcagaaggctggctcttcgcttattaagcacgccgaggagatactacggaaaagaggggcagatctgctttggtgcaatgcacgcacgtcagccgccggttactataaaaggcttggttttagtgagcagggcgaaattttcgacaccccgccggttgggccgcacattcttatgtacaaaaaaatcact

SEQ ID NO: 234 - DNA, 441 bp, Artificial Sequence
  Synthetic nucleic acid sequence
  3_11A10
atgctagaggtgaaaccgattaacgcagaggatacctatgaactaaggcatagaatactcagaccaaaccagccgatagaagcgtgtatgtatgaaagcgatttacttcgtggtgcatttcacttaggcggctattacaggggcaaactgatttccatagcttcattccaccaggccgagcactcagaactccaaggccagaaacagtaccagctccgaggtatggctaccttggaaggttatcgtgagcagaaagcgggatcgagtctagttaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 235 - DNA, 441 bp, Artificial Sequence
  Synthetic nucleic acid sequence
  3_14F6
atgctagaggtgaaaccgattaacgcagaggatacctatgaactaaggcatagaatactcagaccaaaccagccgatagaagcgtgtatgtatgaaagcgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacgtccgcctcaggctactacaaaaagttaggcttcagcgagcagggagagatatttgaaacgccgccagtaggacctcacatcctgatgtataaaaggctcacataa

SEQ ID NO: 236 - DNA, 441 bp, Artificial Sequence
  Synthetic nucleic acid sequence
  3_15B2
atgctagaggtgaaaccgattaacgcagaggatacctatgaactaaggcataaaatactcagaccaaaccagccgttagaagtgtgtatgtatgaaaccgatttacttcgtggtgcatttcacttaggcggctattacgggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 237 - DNA, 441 bp, Artificial Sequence
  Synthetic nucleic acid sequence
  3_6A10
atgatagaagtgaaaccgattaacgcagaggatacctatgaactaaggcatagaatactcagaccaaaccagccgatagaagcgtgtatgtatgaaagcgatttacttcgtggtgcatttcacttaggcggctattacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 238 - DNA, 441 bp, Artificial Sequence
  Synthetic nucleic acid sequence
  3_6B1
atgctagaggtgaaaccgattaacgcagaggatacctatgaactaaggcatagaatactcagaccaaaccagccgatagaagcgtgtatgtatgaaagcgatttacttcgtggtgcatttcacttaggcggctattacaggggcaaactgatttccatagcttcattccaccaggccgagcacccagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagaggtatttgaaacgccgccagtaggacctcacatcctgatgtataaaaggatcacataa

SEQ ID NO: 239 - DNA, 441 bp, Artificial Sequence
  Synthetic nucleic acid sequence
  3_7F9
atgctagaggtgaaaccgattaacgcagaggatacctatgaactaaggcatagaatactcagaccaaaccagccgatagaagcgtgtatgtatgaaagcgatttacttcgtggtgcatttcacttaggcggctattacgggggcaaactgatttccatagcttcattccaccaggccgagcactcagacctccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 240 - DNA, 441 bp, Artificial Sequence
  Synthetic nucleic acid sequence
  3_8G11
atgctagaggtgaaaccgattaacgcagaggatacctatgaactaaggcatagaatactcagacccaaccagccgatagaagtgtgtatgtatgaaagcgatttacttcgtggtgcatttcacttaggcggctattacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 241 - DNA, 441 bp, Artificial Sequence
  Synthetic nucleic acid sequence
  4_1B10
atgatagaagtgaaacctattaacgcagaggatacctatgaactaaggcatagaatactcagaccaaaccagccgatagaagtgtgtatgtatgaaaccgatttacttcgtggtgcatttcacttaggcggcttttacgggggcaaactgatttccatagcttcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacaaaaagttaggcttcagcgagcagggagagatatttgaaacgccgccagtaggacctcacatcctgatgtataaaaggatcacataa

SEQ ID NO: 242 - DNA, 441 bp, Artificial Sequence
  Synthetic nucleic acid sequence
  5_2B3
atgatagaagtgaaacctattaacgcagaggatacctatgaactaaggcatagaatactcagaccaaaccagccgttagaagtgtgtatgtatgaaaccgatttacttcgtggtgcatttcacttaggcggcttttacgggggcaaactgatttccatagcttcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacatgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 243 - DNA, 441 bp, Artificial Sequence
  Synthetic nucleic acid sequence
  5_2D9
  misc_feature 9, 76, 98: n = A,T,C or G
atgctagangtgaaaccgattaacgcagaggatacctatgaactaaggcataaaatactcagaccaaaccagccgntagaagtgtgtatgtatgaaancgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgatcagaaagcgggatcgagtctaattaaacacgctgaacaaattcttcgtgagaggggggcggacatgctttggtgcaatgcgcggacatccgcctcaggctactacaaaaagttaggcttcagcgagcagggagaggtatttgacacgccgccagtaggacctcacatcctgatgtataaaaggctcacataa

SEQ ID NO: 244 - DNA, 441 bp, Artificial Sequence
  Synthetic nucleic acid sequence
  5_2F10
atgctagaagtgaaacctattaacgcagaggatacctatgaactaaggcataaaatactcagaccaaaccagccgatagaagtgtgtatgtatgaaaccgatttacttcgtggtgcatttcacttaggcggcttttacgggggcaaactgatttccatagcttcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacaaaaagttaggcttcagcgagcagggagagatatttgaaacgccgccagtaggacctcacatcctgatgtataaaaggctcacataa

SEQ ID NO: 245 - DNA, 441 bp, Artificial Sequence
  Synthetic nucleic acid sequence
  6_1A11
atgctagaggtgaaaccgattaacgcagaggatacctatgaactaaggcataaaatactcagaccaaaccagccgttagaagtgtgtatgtatgaaaccgatttacttcgtggtgcatttcacttaggcggcttttacaggggcaaactgatttccatagcgtcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacagaaagttaggcttcagcgagcagggagaggtatttgaaacgccgccagtaggacctcacatcctgatgtataaaaggctcacataa

SEQ ID NO: 246 - DNA, 441 bp, Artificial Sequence
  Synthetic nucleic acid sequence
  6_1D5
atgatagaggtgaaaccgattaacgcagaggatacctatgaactaaggcataaaatactcagaccaaaccagccgttagaagtgtgtatgtatgaaaccgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacaaaaagttaggcttcagcgagcagggggaggtatttgaaacgccgccagtaggacctcacatcctgatgtataaaaggatcacataa

SEQ ID NO: 247 - DNA, 441 bp, Artificial Sequence
  Synthetic nucleic acid sequence
  6_1F11
atgatagaggtgaaaccgattaacgcagaggatacctatgaactaaggcataaaatactcagaccaaaccagccgttagaagtgtgtatgtatgaaaccgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgagcagaaagcgggatcgagtctaattagacacgctgaacaaattcttcgtaagaggggggcggacatgctttggtgcaatgcgcggacatccgcctcaggctactacaaaaagttaggcttcagcgagcagggagaggtatttgaaacgccgccagtaggacctcacatcctgatgtataaaaggctcacataa

SEQ ID NO: 248 - DNA, 441 bp, Artificial Sequence; identical to SEQ ID NO: 247
  Synthetic nucleic acid sequence
  6_1F1

SEQ ID NO: 249 - DNA, 441 bp, Artificial Sequence
  Synthetic nucleic acid sequence
  6_1H10
atgctagaggtgaaaccgattaacgcagaggatacctatgaactaaggcataaaatactcagaccaaaccagccgttagaagtgtgtatgtatgaaaccgatttacttcgtggtgcatttcacttaggcggcttttacgggggcaaactgatttccatagcttcattccaccaggccgagcactcggacctccaaggccagaaacagtaccagctccgaggtatggctaccttggaaggttatcgtgatcagaaagcgggatcgagtctaattagacacgctgaagaaattcttcgtaagaggggggcggacatgctttggtgcaatgcgcggacatccgcctcaggctactacaaaaagttaggcttcagcgagcagggagaggtatttgacacgccgccagtaggacctcacatcctgatgtataaaaagatcacataa

SEQ ID NO: 250 - DNA, 441 bp, Artificial Sequence
  Synthetic nucleic acid sequence
  6_1H4
atgctagaagtgaaaccgattaacgcagaggatacctatgaactaaggcataaaatactcagaccaaaccagccgttagaagtgtgtatgtatgaaaccgatttacttcgtggtgcatttcacttaggcggcttttacgggggcaaactgatttccatagcttcattccaccaggccgagcactcagacctccaaggccagaaacagtaccagctccgaggtatggctaccttggaaggttatcgtgatcagaaagcgggatcgactctaattaaacacgctgaacaaattcttcgtaagaggggggcggacatgctttggtgcaatgcgcggacatccgcctcaggctactacaaaaagttaggcttcagcgagcagggagaggtatttgaaacgccgccagtaggacctcacatcctgatgtataaaaggctcacataa

SEQ ID NO: 251 - DNA, 441 bp, Artificial Sequence
  Synthetic nucleic acid sequence
  8_1F8
atgatagaggtgaaaccgattaacgcagaggatacctatgaactaaggcatagaatactcagaccaaaccagccgttagaagtgtgtatgtatgaaaccgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgatacgccgccagtaggacctcacatcctgatgtataaaaggatcacataa

SEQ ID NO: 252 - DNA, 441 bp, Artificial Sequence
  Synthetic nucleic acid sequence
  8_1G2
atgatagaggtgaaaccgattaacgcagaggatacctatgaactaaggcatagagtactcagaccaaaccagccgttagaagtgtgtatgtatgaaaccgatttacttcgtggtgcatttcacttaggcggctattacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgagacgccgccagtaggacctcacatcctgatgtataaaaggctcacgtaa

SEQ ID NO: 253 - DNA, 441 bp, Artificial Sequence
  Synthetic nucleic acid sequence
  8_1G3
atgctagaggtgaaaccgattaacgcagaggatacttacgaactaaggcataaaatactcagaccaaaccagccgatagaagtgtgtatgtatgaaaccgatttacttcgtggtgcatttcacttaggcggctattacaggggcaaactgatttccatagcttcattccaccaggccgagcactcagaactccaaggccagaaacagtaccagctccgaggtatggctaccttggaaggttatcgtgagcagaaagcgggatcgagtctaattagacacgctgaagaaattcttcgtaagaggggggcggacttgctttggtgtaatgcgcggacatccgcctcaggctactacaaaaagttaggcttcagcgagcagggagagatatttgatacgccgccagtaggacctcacatcctgatgtataaaaggatcacgtaa

SEQ ID NO: 254 - DNA, 441 bp, Artificial Sequence
  Synthetic nucleic acid sequence
  8_1H7
atgctagaggtgaaaccgattaacgcagaggatacctatgaactaaggcatagaatactcagaccaaaccagccgatagaagtgtgtatgtatgaaaccgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacatgctttggtgcaatgcgcggacatccgcctcaggctactacaaaaagttaggcttcagcgagcagggagagatatttgaaacgccgccagtaggacctcacatcctgatgtataaaaggctcacataa

SEQ ID NO: 255 - DNA, 441 bp, Artificial Sequence
  Synthetic nucleic acid sequence
  8_1H9
atgctagaggtgaaaccgattaacgcagaggatacctatgaactaaggcataaaatactcagaccaaaccagccgttagaagtgtgtatgtatgaaaccgatttacttcgtggtgcatttcacttaggcggctattacaggggcaaactgatttccatagcttcattccaccaggccgagcactcagacctccaaggccagaaacagtaccagctccgaggtatggctaccttggaaggttatcgtgagcagaaagcgggatcgagtctaattagacacgctgaagaaattcttcgtaagaggggggcggacttgctttggtgtaatgcgcggacatccgcctcaggctactacaaaaagttaggcttcagcgagcagggagaggtatttgatacgccgccagtaggacctcacatcctgatgtataaaaggctcacataa

SEQ ID NO: 256 - DNA, 441 bp, Artificial Sequence
  Synthetic nucleic acid sequence
  GAT1_21F12
atgattgaagtcaaacctataaacgcggaagatacgtatgagatcaggcaccgcattctccggccgaatcagccgctggaagcatgcaagtatgaaaccgatttgctcgggggcacgtttcacctcggcggatattaccggggcaagctgatcagcatcgcttcctttcataatgccgaacattcagagcttgaaggccaaaaacagtatcagctgagagggatggcgacgcttgaaggataccgtgagcaaaaagcgggaagcacgctcatccgccatgccgaagagcttcttcggaaaaaaggcgcggaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 257 - DNA, 441 bp, Artificial Sequence
  Synthetic nucleic acid sequence
  GAT1_24G3
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcctcctttcatcaagccgaacattcagagcttgaaggccaaaaacagtatcagctgagagggatggcgacacttgaagggtaccgcgagcaaaaagcgggcagtacgcttatccgccatgccgaagagcttcttcggaaaaagggggcagaccttttatggtgcaatgccaggacatttgtgagcggttactatgaaaagctcggtttcagcgaacagggcgaagtctacgacataccgccgatcggaccttatattttgatgtattagaaattgacataa

SEQ ID NO: 258 - DNA, 441 bp, Artificial Sequence
  Synthetic nucleic acid sequence
  GAT1_29G1
atgattgaagtcaaaccaataaacgcggaagatacgtatgagatcaggcaccgcattctccggccgaatcagccgcttgaagcatgtatgtatgaaaccgatttgctcgggggtacgtttcacctcggtggatattaccggggcaagctgatcagcatcgcttcctttcatcaagccgaacattcagagcttgaaggccaaaaacagtatcagctgagagggatggcgacacttgaagggtaccgcgagcaaaaagcgggtagtacgcttatccgccatgccgaagagcttcttcggaaaaagggggcagaccttttatggtgcaacgccaggacatctgtgagcgggtactataaaaagctcggcttcagcgaacaaggcggggtctgcgatataccgccgatcggacctcatattttgatgtataagaaattggcataa

SEQ ID NO: 259 - DNA, 441 bp, Artificial Sequence
  Synthetic nucleic acid sequence
  GAT1_32G1
atgattgaagtcaaaccaataaacgcggaagatacgtatgagatcaggcaccgcatactccggccgaatcagccgcttgaagcatgtatgtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaaaggcgcagaccttttatggtgcaacgccaggacatctgtgagcggctactatgaaaagctcggcttcagcgaacagggcgaagtctacgacataccgccgatcggacctcatattttgatgtataagaaattgacataa

SEQ ID NO: 260 - DNA, 441 bp, Artificial Sequence
  Synthetic nucleic acid sequence
  GAT2_15G8
atgattgaagtcaaaccaataaacgcggaagatacgtatgagatcaggcaccgcattctccggccgaatcagccgctggaagcatgcaagtatgaaaccgatttgctcgggggcacgtttcacctcggtggatattaccggggcaagctgatcagcatcgcttcctttcataatgccgaacattcagagcttgaaggccaaaaacagtatcagctgagagggatggcgacgcttgaagggtaccgcgagcaaaaagcgggaagcacgctcatccgccatgccgaagagcttcttcggaaaaaaggcgcagaccttttatggtgcaacgccaggacatctgtgagcgggtactataaaaagctcggcttcagcgaacagggcgaagtctacgacataccgccgatcggacctcatattttgatgtataagaaattgacgtaa

SEQ ID NO: 261 - DNA, 441 bp, Artificial Sequence
  Synthetic nucleic acid sequence
  GAT2_19H8
atgattgaagtcaaaccaataaacgcggaagatacgtatgagatcaggcaccgcatactccggccgaatcagccgcttgaagcatgtatgtatgaaaccgatttgctcgggggcacgtttcacctcggtggatattaccggggcaagctgatcagcatcgcttcctttcatcaagccgaacatccagagcttgaaggccaaaaacagtatcagctgagagggatggcgacacttgaagggtaccgcgagcaaaaagcgggcagtacgcttatccgccatgccgaagagcttcttcggaaaaaaggcgcagaccttttatggtgcaacgccaggacatctgtgagcggctactatgaaaagctcggcttcagcgaacagggcgaagtctgcgacataccgccgatcggacctcatattttgatgtataagaaattgacataa

SEQ ID NO: 262 - DNA, 441 bp, Artificial Sequence
  Synthetic nucleic acid sequence
  GAT2_21F1
atgattgaagtcaaaccaataaacgcggaagatacgtatgagatcaggcaccgcattctccggccgaatcagccgcttgaagcatgtatgtatgaaaccgatttgctcgggggcacgtttcacctcggtggatattaccggggcaagctgatcagcatcgcttcctttcatcaagccgaacattcagagcttgaaggccaaaaacagtatcagctgagagggatggcgacacttgaaggataccgtgagcaaaaagcgggcagtacgcttatccgccatgccgaagagcttcttcggaaaaagggggcagaccttttatggtgcaacgccaggacatctgtgagcgggtactataaaaagctcggcttcagcgaacaaggcggggtctacgatataccgccgatcggacctcatattttgatgtataagaaattgacgtaa

SEQ ID NO: 263 - protein, 146 aa, Artificial Sequence
  Synthetic Protein Sequence
  13_10F6
MIEVKPINAEDTYEIRHRILRPNQPLEACKYETDLLRGTFHLGGYYRGKLISIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 264 - protein, 146 aa, Artificial Sequence
  Synthetic Protein Sequence
  13_12G6
MIEVKPINAEDTYEIRHRILRPNQPLEACKYETDLLRGAFHLGGYYRGKLVSIASFHQAEHPELEGQRQYQLRGMATLEGYREQKAGSTLIRHAEELLRKKGADLLWCNARTSASGYYKKLGFSEQGEVYDIPPTGPHILMYKKLT

SEQ ID NO: 265 - protein, 146 aa, Artificial Sequence
  Synthetic Protein Sequence
  14_2A5
MIEVKPINAEDTYEIRHRILRPNQPLEACKYETDLLGSTFHLGGYYRGKLISIASFNQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 266 - protein, 146 aa, Artificial Sequence
  Synthetic Protein Sequence
  14_2C1
MIEVKPINAEDTYEIRHRILRPNQPLEACKYETDLLRGAFHLGGYYRGKLVSIASFHQAEHPELEGQKQYQLRGMATLEGYREQKAGSTLIRHAEELLRKKGADLLWCNARTSASGYYKKLGFSEQGEVYDTPPTGPHILMYKKLT

SEQ ID NO: 267 - protein, 146 aa, Artificial Sequence
  Synthetic Protein Sequence
  14_2F11
MIEVKPINAEDTYEIRHRILRPNQPLEACKYETDLLRGAFHLGGYYRGKLVSIASFHQAEHPELEGQKQYQLRGMATLEGYREQKAGSTLIRHAEALLRKKGADLLWCNARTSASGYYKKLGFSEQGEVYDTPPAGPHILMYKKLT

SEQ ID NO: 268 - protein, 146 aa, Artificial Sequence
  Synthetic Protein Sequence
  CHIMERA
MIEVKPINAEDTYEIRHRILRPNQPLEACMYETDLLRGAFHLGGYYRGKLISIASFHQAEHSELEGQKQYQLRGMATLEGYREQKAGSTLIRHAEELLRKKGADLLWCNARTSASGYYKKLGFSEQGEVYDTPPVGPHILMYKKLT

SEQ ID NO: 269 - protein, 146 aa, Artificial Sequence
  Synthetic Protein Sequence
  10_12D7
MIEVKPINAEDTYEIRHRILRPNQPLEACKYETDLLGGTLHLGGYYRGKLISIASFHQAEHPELEGQKQYQLRGMATLEEYREQKAGSTLIRHAEELLRKKGADLLWCNARTSASGYYKKLGFSEQGEVYDIPPTGPHILMYKKLT

SEQ ID NO: 270 - protein, 146 aa, Artificial Sequence
  Synthetic Protein Sequence
  10_15F4
MIEVKPINAEDTYEIRHRILRPNQPLEACMYETDLLRGTFHLGGYYRGKLVSIASFHQAEHPELEGQKQYQLRGMATLEEYREQKAGSTLIRHAEELLRKKGADLLWCNARTSASGYYKKLGFSEQGGVYDIPPVGPHILMYKKLT

SEQ ID NO: 271 - protein, 146 aa, Artificial Sequence
  Synthetic Protein Sequence
  10_17D1
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 272 - protein, 146 aa, Artificial Sequence
  Synthetic Protein Sequence
  10_17F6
MIEVKPINAEDTYEIRHRILRPNQPLEACKYETDLLGGTFHLGGYYRGKLVSIASFHQAEHSELEGQKQYQLRGMATLEEYREQKAGSTLIRHAEELLRKKGADLLWCNARTSASGYYKKLGFSEQGEVYDIPPVGPHILMYKKLT

SEQ ID NO: 273 - protein, 146 aa, Artificial Sequence
  Synthetic Protein Sequence
  10_18G9
MIEVKPINAEDTYEIRHRILRPNQPLEACKYETDLLGGTFHLGGYYRGKLVSIASFHQAEHSELEGQKQYQLRGMATLEEYREQKAGSTLIRHAEELLRKKGADLLWCNARTSASGYYKKLGFSEQGGVYDIPPVGPHILMYKKLT

SEQ ID NO: 274 - protein, 146 aa, Artificial Sequence
  Synthetic Protein Sequence
  10_1H3
MIEVKPINAEDTYEIRHRILRPNQPLEACKYETDLLGGTFHLGGYYRGKLVSIASFHQAEHPELEGRKQYQLRGMATLEGYREQKAGSTLIRHAEELLRKKGADLLWCNARTSASGYYKKLGFSEQGEVYDIPPTGPHILMYKKLT

SEQ ID NO: 275 - protein, 146 aa, Artificial Sequence
  Synthetic Protein Sequence
  10_20D10
MIEVKPINAEDTYEIRHRILRPNQPLEACMYETDLLGGTLHLGGYYRGKLISIASFHQAEHPELEGQKQYQLRGMATLEEYREQKAGSTLIRHAEELLRKKGADLLWCNARTSASGYYKKLGFSEQGGVYDIPPVGPHILMYKKLT

SEQ ID NO: 276 - protein, 146 aa, Artificial Sequence
  Synthetic Protein Sequence
  10_23F2
MIEVKPINAEDTYEIRHRILRPNQPLEACMYETDLLGGTFHLGGYYRGKLVSIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 277 - protein, 146 aa, Artificial Sequence
  Synthetic Protein Sequence
  10_2B8
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRKKGADLLWCNARTSASGYYKKLGFSEQGEVYDTPPVGPHILMYKKLT

SEQ ID NO: 278 - protein, 146 aa, Artificial Sequence
  Synthetic Protein Sequence
  10_2C7
MIEVKPINAEDTYEIRHRILRPNQPLEACKYETDLLRGAFHLGGYYRGKLISIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 279 - protein, 146 aa, Artificial Sequence
  Synthetic Protein Sequence
  10_3G5
MIEVKPINAEDTYEIRHRILRPNQPLEACKYETDLLGGTFHLGGYYRGKLVSIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 280 - protein, 146 aa, Artificial Sequence
  Synthetic Protein Sequence
  10_4H7
MIEVKPINAEDTYEIRHRILRPNQPLEACMYETDLLGGTFHLGGYYRGKLVSIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 281 - protein, 146 aa, Artificial Sequence
  Synthetic Protein Sequence
  10_6D11
MIEVKPINAEDTYEIRHRILRPNQPLEACKYETDLLGGTLHLGGYYRGKLVSIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 282 - protein, 146 aa, Artificial Sequence
  Synthetic Protein Sequence
  10_8C6
MIEVKPINAEDTYEIRHRILRPNQPLEACKYETDLLGGAFHLGGYYRGKLISIASFHQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 283 - protein, 146 aa, Artificial Sequence
  Synthetic Protein Sequence
  11C3
MIEVKPINAEDTYEIRHRILRPNQPLEACKYETDLLGGTFHLGGYYQGKLISIASFHQAEHSELEGQKQYQLRGMATLEGYREQKAGSTLIRHAEELLRKKGADLLWCNARTSVSGYYKKLGFSEQGGVYDIPPIGPHILMYKKLT

SEQ ID NO: 284 - protein, 146 aa, Artificial Sequence
  Synthetic Protein Sequence
  11G3
MIEVKPINAEDTYEIRHRILRPNQPLEACMYETDLLGGTFHLGGYYQGKLISIASFHQAEHSELEGQKQYQLRGMATLEGYREQKAGSTLIRHAEELLRKKGADLLWCNARTSASGYYEKLGFSEQGGVYDIPPIGPHILMYKKLA

SEQ ID NO: 285 - protein, 146 aa, Artificial Sequence
  Synthetic Protein Sequence
  11H3
MIEVKPINAEDTYEIRHRILRPNQPLEACMYETDLLGGAFHLGGYYQGKLISIASFHKAEHSELEGQKQYQLRGMATLEGYREQKAGSTLIRHAEELLRKKGADLLWCNARTSVRGYYEKLGFSEQGGVYDIPPIGPHILMYKKLT

SEQ ID NO: 286 - protein, 146 aa, Artificial Sequence
  Synthetic Protein Sequence
  12_1F9
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVHDIPPTGPHILMYKKLT

SEQ ID NO: 287 - protein, 146 aa, Artificial Sequence
  Synthetic Protein Sequence
  12_2G9
MIEVKPINAEDTYEIRHRILRPNQPLEACKYETDLLGGTFHLGGYYRGKLVSIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 288 - protein, 146 aa, Artificial Sequence
  Synthetic Protein Sequence
  12_3F1
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 289 - protein, 146 aa, Artificial Sequence
  Synthetic Protein Sequence
  12_5C10
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRKKGADLLWCNARTSASGYYKKLGFSEQGEVYDAPPTGPHILMYKKLT

SEQ ID NO: 290 - protein, 146 aa, Artificial Sequence
  Synthetic Protein Sequence
  12_6A10
MIEVKPINAEDTYEIRHRILRPNQPLEACKYETDLLGGTFHLGGYYRGKLVSIASFHQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 291 - protein, 146 aa, Artificial Sequence
  Synthetic Protein Sequence
  12_6D1
MIEVKPINAEDTYEIRHRILRPNQPLEACMYETDLLGGTFHLGGYYRGKLISIASFHQAEHPELEGQKQYQLRGMATLEEYREQKAGSTLIRHAEELLRKKGADLLWCNARTSASGYYKKLGFSEQGGVYDIPPVGPHILMYKKLT

SEQ ID NO: 292 - protein, 146 aa, Artificial Sequence
  Synthetic Protein Sequence
  12_6F9
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 293 - protein, 146 aa, Artificial Sequence
  Synthetic Protein Sequence
  12_6H6
MIEVKPINAEDTYEIRHRILRPNQPLEACKYETDLLGGTFHLGGYYRGKLVSIASFHQAEHPELEGQKQYQLRGMATLEGYREQKAGSTLIRHAEALLRKKGADLLWCNARTSASGYYKKLGFSEQGEVYDIPPTGPHILMYKKLT

SEQ ID NO: 294 - protein, 146 aa, Artificial Sequence
  Synthetic Protein Sequence
  12_7D6
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDIPPTGPHILMYKKLT

SEQ ID NO: 295 - protein, 146 aa, Artificial Sequence
  Synthetic Protein Sequence
  12_7G11
MIEVKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGEVYDTPPVGPHILMYKKLT

SEQ ID NO: 296 - protein, 146 aa, Artificial Sequence
  Synthetic Protein Sequence
  12F5
MIEVKPINAEDTYEIRHRILRPNQPLEACMYETDLLGGTFHLGGYYQGKLISIASFHKAEHSELEGQKQYQLRGMATLEGYREQKAGSTLIRHAEELLRKKGADLLWCNARTSVSGYYKKLGFSEQGGIYDIPPIGPHILMYKKLT

SEQ ID NO: 297 - protein, 146 aa, Artificial Sequence
  Synthetic Protein Sequence
  12G7
MIEVKPINAEDTYEIRHRILRPNQPLEACKYETDLLGGTFHLGGYYQGKLISIASFHKAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 298 - protein, 146 aa, Artificial Sequence
  Synthetic Protein Sequence
  1_2H6
MIEVKPINAEDTYEIRHRILRPNQPLEACMYETDLLGGAFHLGGYYRGKLISIASFHQAEHSELEGQKQYQLRGMATLEGYREQKAGSTLIRHAEELLRKKGADLLWCNARTSASGYYKKLGFSEQGGVYDIPPIGPHILMYKKLT

SEQ ID NO: 299 - protein, 146 aa, Artificial Sequence
  Synthetic Protein Sequence
  13_12G12
MIEVKPINAEDTYEIRHRILRPNQPLEACMYETDLLGGTFHLGGYYRGKLISIASFNQAEHPELEGQKQYQLRGMATLEEYREQKAGSTLIRHAEELLRKKGADLLWCNARTSASGYYKKLGFSEQGEVYDIPPVGPHILMHKKLT

SEQ ID NO: 300 - protein, 146 aa, Artificial Sequence
  Synthetic Protein Sequence
  13_6D10
MIEVKPINAEDTYEIRHRILRPNQPLEACMYETDSLGGTFHLGGYYRGKLISIASFNQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 301 - protein, 146 aa, Artificial Sequence
  Synthetic Protein Sequence
  13_7A7
MIEVKPINAEDTYEIRHRILRPNQPLEACMYETDLLRSAFHLGGYYRGKLISIASFHQAEHPELEGQKQYQLRGMATLEEYREQKAGSTLIRHAEELLRKKGADLLWCNARTSASGYYKKLGFSEQGEVYDTPPVGPHILMYKKLT

SEQ ID NO: 302 - protein, 146 aa, Artificial Sequence
  Synthetic Protein Sequence
  13_7B12
MIEVKPINAEDTYEIRHRILRPNQPLEACKYETDLLGSTFHLGGYYRGKLISIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 303 - protein, 146 aa, Artificial Sequence
  Synthetic Protein Sequence
  13_7C1
MIEVKPINAEDTYEIRHRILRPNQPLEACKYETDLLRGAFHLGGYYRGKLISIASFHQAEHPELEGQKQYQLRGMATLEGYREQKAGSTLIRHAEELLRKKGADLLWCNARTSARGYYKKLGFSEQGEVYDIPPTGPHILMYKKLT

SEQ ID NO: 304 - protein, 146 aa, Artificial Sequence
  Synthetic Protein Sequence
  13_8G6
MIEVKPINAEDTYEIRHRILRPNQPLEACKYETDSLGGTFHLGGYYRGKLISIASFNQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 305 - protein, 146 aa, Artificial Sequence
  Synthetic Protein Sequence
  13_9F6
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRKKGADLLWCNARTSASGYYKKLGFSEQGEVYDIPPVGPHILMYKKLT

SEQ ID NO: 306 - protein, 146 aa, Artificial Sequence
  Synthetic Protein Sequence
  14_10C9
MIEVKPINAEDTYEIRHRILRPNQPLEACKYETDLLRGAFHLGGYYRGKLISIASFHQAEHPELEGQKQYQLRGMATLEEYREQKAGSTLIRHAEELLRKKGADLLWCNARTSASGYYKKLGFSEQGEVYDTPPVGPHILMYKKLT

SEQ ID NO: 307 - protein, 146 aa, Artificial Sequence
  Synthetic Protein Sequence
  14_10H3
MIEVKPINAEDTYEIRHRILRPNQPLEACKYETDLLRGAFHLGGYYRGKLVSIASFHQAEHPELEGQKQYQLRGMATLEEYREQKAGSTLIRHAEELLRKKGADLLWCNARTSASGYYKKLGFSEQGEVYDTPPVGPHILMYKKLT

SEQ ID NO: 308 - protein, 146 aa, Artificial Sequence
  Synthetic Protein Sequence
  14_10H9
MIEVKPINAEDTYEIRHRILRPNQPLEACKYETDLLRGAFHLGGYYRGKLVSIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 309 - protein, 146 aa, Artificial Sequence
  Synthetic Protein Sequence
  14_11C2
MIEVKPINAEDTYEIRHRILRPNQPLEACKYETDLLGSTFHLGGYYRGKLVSIASFHQAEHPELEGQKQYQLRGMATLEEYREQKAGSTLIRHAEALLRKKGADLLWCNARTSASGYYKKLGFSEQGEVYDTPPTGPHILMYKKLT

SEQ ID NO: 310 - protein, 146 aa, Artificial Sequence
  Synthetic Protein Sequence
  14_12D8
MIEVKPINAEDTYEIRHRILRPNQPLEACKYETDLLGGTFHLGGYYRGKLVSIASFHQAEHPELEGQKQYQLRGMATLEGYREQKAGSTLIRHAEALLRKKGADLLWCNARTSASGYYKKLGFREQGGVYDIPPVGPHILMYKKLT

SEQ ID NO: 311 - protein, 146 aa, Artificial Sequence
  Synthetic Protein Sequence
  14_12H6
MIEVKPINAEDTYEIRHRILRPNQPLEACKYETDLLGGAFHLGGYYRGKLISIASFHQAEHPELEGQKQYQLRGMATLEEYREQKAGSTLIRHAEELLRKKGADLLWCNARTSASGYYKKLGFSEQGEVYDIPPTGPHILMYKKLT

SEQ ID NO: 312 - protein, 146 aa, Artificial Sequence
  Synthetic Protein Sequence
  14_2B6
MIEVKPINAEDTYEIRHRILRPNQPLEACKYETDLLGGTFHLGGYYRGKLISIASFNQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 313 - protein, 146 aa, Artificial Sequence
  Synthetic Protein Sequence
  14_2G11
MIEVKPINAEDTYEIRHRILRPNQPLEACKYETDLLRGAFHLGGYYRGKLVSIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 314 - protein, 146 aa, Artificial Sequence
  Synthetic Protein Sequence
  14_3B2
MIEVKPINAEDTYEIRHRILRPNQPLEACKYETDLLRGAFHLGGYYRGKLVSIASFHQAEHPELEGQKQYQLRGMATLEGYREQKAGSTLIRHAEALLRKKGADLLWCNARTSASGYYKKLGFSEQGGVYDIPPAGPHILMYKKLT

SEQ ID NO: 315 - protein, 146 aa, Artificial Sequence
  Synthetic Protein Sequence
  14_4H8
MIEVKPINAEDTYEIRHRILRPNQPLEACKYETDLLGSTFHLGGYYRGKLISIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 316 - protein, 146 aa, Artificial Sequence
  Synthetic Protein Sequence
  14_6A8
MIEVKPINAEDTYEIRHRILRPNQPLEACMYETDLLGGTFHLGGYYRGKLVSIASFNQAEHPELEGQKQYQLRGMATLEGYREQKAGSTLIRHAEELLRKKGADLLWCNARTSASGYYKKLGFSEQGEVYDTPPVGPHVLMYKKLT

SEQ ID NO: 317 - protein, 146 aa, Artificial Sequence
  Synthetic Protein Sequence
  14_6B10
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDMPPVGPHILMYKKLT

SEQ ID NO: 318 - protein, 146 aa, Artificial Sequence
  Synthetic Protein Sequence
  14_6D4
MIEVKPINAEDTYEIRHRILRPNQPLEACKYETDLLGGTFHLGGYYRGKLISIASFNQAEHPELEGQKQYQLRGMATLEGYREQKAGSTLIRHAEALLRKKGADLLWCNARTSASGYYKKLGFSEQGEVYDTPPVGPHILMYKKLT

SEQ ID NO: 319 - protein, 146 aa, Artificial Sequence
  Synthetic Protein Sequence
  14_7A11
MIEVKPINAEDTYEIRHRILRPNQPLEACKYETDLLRGAFHLGGYYRGKLVSIASFHQAEHPELEGLKQYQLRGMATLEGYREQKAGSTLIRHAEELLRKKGADLLWCNARTSASGYYKKLGFSEQGEVYDTPPTGPHILMYKKLT

SEQ ID NO: 320 - protein, 146 aa, Artificial Sequence
  Synthetic Protein Sequence
  14_7A1
MIEVKPINAEDTYEIRHRILRPNQPLEACMYETDLLRGTFHLGGYYRGKLVSIASFHQAEHPELEGQKQYQLRGMATLEEYREQKAGSTLIRHAEELLRKKGADLLWCNARTSASGYYKKLGFSEQGEVYDTPPAGPHILMYKKLT

SEQ ID NO: 321 - protein, 146 aa, Artificial Sequence
  Synthetic Protein Sequence
  14_7A9
MIEVKPINAEDTYEIRHRILRPNQPLEACKYETDLLGGTFHLGGYYRGKLVSIASFHQAKHPELEGQKQYQLRGMATLEGYREQKAGSTLIRHAEELLRKKGADLLWCNARTSASGYYKKLGFSEQGEVYDTPPVGPHILMYKKLT

SEQ ID NO: 322 - protein, 146 aa, Artificial Sequence
  Synthetic Protein Sequence
  14_7G1
MIEVKPINAEDTYEIRHRILRPNQPLEACKYETDLLRGAFHLGGYYRGKLISIASFNQAEHPELEGQKQYQLRGMATLEEYREQKAGSTLIRHAEALLRKKGADLLWCNARTSASGYYKKLGFSEQGEVYDTPPVGPHILMYKKLT

SEQ ID NO: 323 - protein, 146 aa, Artificial Sequence
  Synthetic Protein Sequence
  14_7H9
MIEVKPINAEDTYEIRHRILRPNQPLEACKYETDLLGGTFHLGGYYRGKLVSIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 324 - protein, 146 aa, Artificial Sequence
  Synthetic Protein Sequence
  14_8F7
MIEVKPINAEDTYEIRHRILRPNQPLEACKYETDLLGGTFHLGGYYRGKLVSIASFHQAEHPELEGQKQYQLRGMATLEEYREQKAGSTLIRHAEALLRKKGADLLWCNARTSASGYYKKLGFSEQGEVYDIPPTGPHILMYKKLT

SEQ ID NO: 325 - protein, 146 aa, Artificial Sequence
  Synthetic Protein Sequence
  15_10C2
MIEVKPINAEDTYEIRHRILRPNQPLEACKYETDLLRGAFHLGGYYRGKLVSIASFHQAEHPELEGQKQYQLRGMATLEGYREQKAGSTLIRHAEELLRKKGADLLWCNARTTASGYYKKLGFSEQGEVFDIPPTGPHILMYKKLT

SEQ ID NO: 326 - protein, 146 aa, Artificial Sequence
  Synthetic Protein Sequence
  15_10D6
MIEVKPINAEDTYEIRHRILRPNQPLEACMYETDLLGGTFHLGGYYRGKLVSIASFHQAEHPELEGQKQYQLRGMATLEEYREQKAGSTLIRHAEELLRKKGADLLWCNARTSASGYYKKLGFSEQGEVYDIPPVGPHILMYKKLT

SEQ ID NO: 327 - protein, 146 aa, Artificial Sequence
  Synthetic Protein Sequence
  15_11F9
MIEVKPINAEDTYEIRHRILRPNQPLEACKYETDLLRGAFHLGGYYRGKLVSIASFNQAEHPELEGQKQYQLRGMATLEGYREQKAGSTLIRHAEELLRRKGADLLWCNARTSASGYYKKLGFSEQGEVYDIPPTGPHILMYKKLT

SEQ ID NO: 328 - protein, 146 aa, Artificial Sequence
  Synthetic Protein Sequence
  15_11H3
MIEVKPINAEDTYEIRHRILRPNQPLEACKYETDLLRGAFHLGGYYRGKLISIASFHQAEHPELEGQKQYQLRGMATLEGYREQKAGSTLIRHAEALLRKKGADLLWCNARTSASGYYKKLGFSEQGEVYDIPPTGPHILMYKKLT

SEQ ID NO: 329 - protein, 146 aa, Artificial Sequence
  Synthetic Protein Sequence
  15_12A8
MIEVKPINAEDTYEIRHRILRPNQPLEACKYETDLLGGTFHLGGYYRGKLISIASFHQAEHPELEGQKQYQLRGMATLEGYREQKAGSTLIRHAEALLRKKGADLLWCNARTSASGYYKKLGFSEQGEVYDIPPTGPHILMYKKLT

SEQ ID NO: 330 - protein, 146 aa, Artificial Sequence
  Synthetic Protein Sequence
  15_12D6
MIEVKPINAEDTYEIRHRILRPNQPLEACMYETDLLRGAFHLGGYYRGKLVSIASFHQAEHPELEGQKQYQLRGMATLEGYREQKAGSTLIRHAEELLRKKGADLLWCNARTSASGYYKKLGFSEQGEVYDTPPVGPHILMYKKLT

SEQ ID NO: 331 - protein, 146 aa, Artificial Sequence
  Synthetic Protein Sequence
  15_12D8
MIEVKPINAEDTYEIRHRILRPNQPLEACKYETDLLGGTFHLGGYYRGKLVSIASFHQAEHPELEGQKQYQLRGMATLEGYREQKAGSTLIRHAEELLRKKGADLLWCNARTSASGYYKKLGFSEQGKVYDIPPVGPHILMYKKLT

SEQ ID NO: 332 - protein, 146 aa, Artificial Sequence
  Synthetic Protein Sequence
  15_12D9
MIEVKPINAEDTYEIRHRILRPNQPLEACKYETDLLRGTFHLGGYYRGKLVSIASFHQAEHPELEGQKQYQLRGMATLEEYREQKAGSTLIRHAEELLRKKGADLLWCNARTSASGYYKKLGFSEQGEVYDIPPVGPHILMYKKLT

SEQ ID NO: 333 - protein, 146 aa, Artificial Sequence
  Synthetic Protein Sequence
  15_3F10
MIEVKPINAEDTYEIRHRILRPNQPLEACKYETDLLRGAFHLGGYYRGKLISIVSFHQAEHPELEGQKQYQLRGMATLEGYREQKAGSTLIRHAEELLRKKGADLLWCNARTSASGYYKKLGFSEQGEVYDTPPAGPHILMYTKLT

SEQ ID NO: 334 - protein, 146 aa, Artificial Sequence
  Synthetic Protein Sequence
  15_3G11
MIEVKPINAEDTYEIRHRILRPNQPLEACKYETDLLGGTFHLGGYYRGKLVSIASFHQAEHPELEGQKQYQLRGMATLEEYREQKAGSTLIRHAEELLRKKGADLLWCNARTSASGYYKKLGFSEQGEVYDIPPVGPHILMYKKLT

SEQ ID NO: 335 - protein, 146 aa, Artificial Sequence
  Synthetic Protein Sequence
  15_4F11
MIEVKPINAEDTYKIRHRILRPNQPLEACMYETDLLGGTFHLGGYYRGKLVSIASFNQAEHPELEGQKQYQLRGMATLEGYREQKAGSTLIRHAEALLRKKGADLLWCNARTSASGYYKKLGFSEQGEVYDIPPTGPHILMYKKLT

SEQ ID NO: 336 - protein, 146 aa, Artificial Sequence
  Synthetic Protein Sequence
  15_4H3
MIEVKPINAEDTYEIRHRILRPNQPLEACKYETDLLGGTFHLGGYYRGKLVSIASFHQAEHPELEGQKQYQLRGMATLEEYREQKAGSTLIRHAEELLRKKGADLLWCNARTSASGYYKKLGFSEQGEVYDIPPTGPHILMYKKLT

SEQ ID NO: 337 - protein, 146 aa, Artificial Sequence
  Synthetic Protein Sequence
  15_6D3
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRKKGADLLWCNARTSASGYYKKLGFSEQGEVYDIPPTGPHILMYKKLT

SEQ ID NO: 338 - protein, 146 aa, Artificial Sequence
  Synthetic Protein Sequence
  15_6G11
MIEVKPINAEDTYEIRHRILRPNQPLEACKYETDLLRGAFHLGGYYRGKLVSIASFHQAEHPELEGQKQYQLRGMATLEEYREQKAGSTLIRHAEELLRKKGADLLWCNARTSASGYYKKLGFSEQGKVYDIPPVGPHILMYKKLT

SEQ ID NO: 339 - protein, 146 aa, Artificial Sequence
  Synthetic Protein Sequence
  15_9F6
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRRKGADLLWCNARTSASGYYKKLGFSEQGEVYDIPPVGPHILMYKKLT

SEQ ID NO: 340 - protein, 146 aa, Artificial Sequence
  Synthetic Protein Sequence
  15F5
MIEVKPINAEDTYEIRHRILRPNQPLEACKYETDLLGGTFHLGGYYRGKLISIASFHKAEHSELEGEEQYQLRGMATLEGYREQKAGSTLIRYAEELLRKKGADLLWCNARTSVSGYYKKLGFSEQGEVYDIPPIGPHILMYKKLT

SEQ ID NO: 341 - protein, 146 aa, Artificial Sequence
  Synthetic Protein Sequence
  16A1
MIEVKPINAEDTYEIRHRILRPNQPLEACMYETDLLGGTLHLGGYYQGKLISIASFHKAEHSGLEGEEQYQLRGMATLEGYREQKAGSTLIRHAEELLRKKGADLLWCNARTSVSGYYEKLGFSEQGEVYDIPPIGPHILMYKKLT

SEQ ID NO: 342 - protein, 146 aa, Artificial Sequence
  Synthetic Protein Sequence
  16H3
MIDVKPINAEDTYEIRHRILRPNQPLEACKYETDLLGGTFHLGGYYQGKLISIASFHQAEHSELEGQKQYQLRGMATLEGYREQKAGSTLIRHAEELLRKKGADLLWCNARTSVSGYYEKLGFSEQGEVYDIPPIGPHILMYKKLT

SEQ ID NO: 343 - protein, 146 aa, Artificial Sequence
  Synthetic Protein Sequence
  17C12
MIEVKPISAEDTYEIRHRILRPNQPLEACMYETDLLGGAFHLGGYYQGKLISIASFHQAEHSELEGQKQYQLRGMATLEGYREQKAGSTLIRHAEELLRKKGADLLWCNARTSVSGYYEKLGFSEQGEVYDIPPIGPHILMYKKLT

SEQ ID NO: 344 - protein, 146 aa, Artificial Sequence
  Synthetic Protein Sequence
  18D6
MIEVKPINAEDTYEIRHRILRPNQPLEACKYETDLLGGTFHLGGYYRGKLISIASFHKAEHSELEGQKQYQLRGMATLEGYREQKAGSTLIRHAEELLRKKGADLLWCNARTSASGYYEKLGFSEQGEVYDIPPIGPHILMYKKLA

SEQ ID NO: 345 - protein, 146 aa, Artificial Sequence
  Synthetic Protein Sequence
  19C6
MIEVKPINAEDTYEIRHRILRPNQPLEACKYETDLLGGTFHLGGYYRGKLICIASFHQAEHSELEGQKQYQLRGMATLEGYREQKAGSTLIRHAEELLRKKGADLLWCNARTSVRGYYEKLGFSEQGGVYDIPPIGPHILMYKKLA

SEQ ID NO: 346 - protein, 146 aa, Artificial Sequence
  Synthetic Protein Sequence
  19D5
MIEVKPINAEDTYEIRHCILRPNQPLEACMYETDLLGGTFHLGGYYQGKLISIASFHKAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 347 - protein, 146 aa, Artificial Sequence
  Synthetic Protein Sequence
  20A12
MIEVKPINAEDTYEIRHRILRPNQPLEACMYETDLLGGTFHLGGYYQGKLISIASFHNAEHSELEGQKQYQLRGMATLEGYREQKAGSTLIRHAEELLRKKGVDLLWCNARTSVSGYYKKLGFSEQGGIYDIPPIGPHILMYKKLA

SEQ ID NO: 348 - protein, 146 aa, Artificial Sequence
  Synthetic Protein Sequence
  20F2
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSVSGYYEKLGFSEQGEVYDIPPIGPHILMYKKLT

SEQ ID NO: 349 - protein, 146 aa, Artificial Sequence
  Synthetic Protein Sequence
  21E11
MIEVKPINAEDTYEIRHRILRPNQPLEACKYETDLLGGAFHLGGYYQGKLISIASFHQAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 350 - protein, 146 aa, Artificial Sequence
  Synthetic Protein Sequence
  23H11
MIEVKPINAEDTYEIRHRILRPNQPLEACMYETDLLGGTFHLGGYYQGKLISIASFHKAEHSELEGQKQYQLRGMATLEGYREQKAGSTLIRHAEELLRKKGADLLWCNARTSASGYYEKLGFSEQGEVYDIPPIGPHILMYKKLA

SEQ ID NO: 351 - protein, 146 aa, Artificial Sequence
  Synthetic Protein Sequence
  24C1
MIEVKPINAEDTYEIRHRILRPNQPLEACKYETDLLGGTFHLGGYYRDRLISIASFHQAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 352 - protein, 146 aa, Artificial Sequence
  Synthetic Protein Sequence
  24C6
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARISVSGYYKKLGFSEQGGVYDIPPIGPHILMYKKLA

SEQ ID NO: 353 - protein, 146 aa, Artificial Sequence
  Synthetic Protein Sequence
  24E7
MIEVKPINAEDTYEIRHRILRPNQPLEACKYETDLLGGTFHLGGYYRGKLISIASFHNAEHSELEGQKQYQLRGMATLEGYREQKAGSTLIRHAEELLRKKGADLLWCNARTSASGYYEKLGFSEQGEVYDIPPIGPHILMYKKLA

SEQ ID NO: 354 - protein, 146 aa, Artificial Sequence
  Synthetic Protein Sequence
  2_8C3
MIEVKPINAEDTYEIRHRILRPNQPLEACMYETDLLGGTFHLGGYYRDRLISIASFHQAEHSELEGQKQYQLRGMATLEGYREQKAGSTLIRHAEELLRKKGADLLWCNARTSASGYYEKLGFSEQGEVYDIPPIGPHILMYKKLT

SEQ ID NO: 355 - protein, 146 aa, Artificial Sequence
  Synthetic Protein Sequence
  2H3
MIEVKPINAEDTYEIRHRILRPNQPLEACKYETDLLGGTFHLGGYYQGKLISTASFHQAGHSELEGQKQYQLRGMATLEGYRERKAGSTLIRHAEELLRKKGADLLWCNARISASGYYKKLGFSEQGGVYDIPPIGPHILMYKKLT

SEQ ID NO: 356 - protein, 146 aa, Artificial Sequence
  Synthetic Protein Sequence
  30G8
MIEVKPINAEDTYEIRHRILRPNQPLEACMFETDLLGGAFHLGGYYQGKLISIASFHQAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 357 - protein, 146 aa, Artificial Sequence
  Synthetic Protein Sequence
  3B_10C4
MIEVRPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGEAYDIPPIGPHILMYKKLT

SEQ ID NO: 358 - protein, 146 aa, Artificial Sequence
  Synthetic Protein Sequence
  3B_10G7
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPIGPHILMYKKLT

SEQ ID NO: 359 - protein, 146 aa, Artificial Sequence
  Synthetic Protein Sequence
  3B_12B1
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGEVYDIPPIGPHILMYKKLT

SEQ ID NO: 360 - protein, 146 aa, Artificial Sequence
  Synthetic Protein Sequence
  3B_12D10
MIEVKPINAEDTYEIRHRILRPNQPLEACMYETDLLGGAFHLGGYYRGKLISIASFHPAEHSELEGQKQYQLRGMATLEGYREQKAGSTLIRHAEELLRKKGADLLWCNARISASGYYEKLGFSEQGEVYDIPPIGPHILMYKKLT

SEQ ID NO: 361 - protein, 146 aa, Artificial Sequence
  Synthetic Protein Sequence
  3B_2E5
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYEKLGFSKQGEVYDIPPIGPHILMYKKLT

SEQ ID NO: 362 - protein, 146 aa, Artificial Sequence
  Synthetic Protein Sequence
  3C_10H3
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARISASGYYKKLGFSEQGGVYDIPPVGPHILMYKKLT

SEQ ID NO: 363 - protein, 146 aa, Artificial Sequence
  Synthetic Protein Sequence
  3C_12H10
MIEVKPINAEDTYEIRHRILRPNQPLEACMYETDLLGGTFHLGGYYRGKLISIASFHQAEHSELEGQKQYQLRGMATLEGYRGQKAGSTLIRHAEELLRKKGADLLWCNARTSASGYYEKLGFSEQGEVYDIPPIGPHILMYKKLT

SEQ ID NO: 364 - protein, 146 aa, Artificial Sequence
  Synthetic Protein Sequence
  3C_9H8
MIEVKPINAEDTYEIRHRILRPNQPLEACMYETDLLGGTFHLGGYYQDRLISIASFHQAEHSELEGQKQYQLRGMATLEGYREQKAGSTLIRYAEELLRKKGADLLWCNARISASGYYEKLGFSEQGEVYDIPPIGPHILMYKKLT

SEQ ID NO: 365 - protein, 146 aa, Artificial Sequence
  Synthetic Protein Sequence
  4A_1B11
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYEKLGFSEQGEVYDIPPIGPHILMYKKLT

SEQ ID NO: 366 - protein, 146 aa, Artificial Sequence
  Synthetic Protein Sequence
  4A_1C2
MIEVKPINAEDTYEIRHRILRPNQPLEACKYETDLLGGTFHLGGYYRGKLISIASFHQAEHSELEGQKQYQLRGMATLEEYREQKAGSTLIRHAEELLRKKGADLLWCNARTSASGYYKKLGFSEQGEVYDIPPIGPHILMYKKLT

SEQ ID NO: 367 - protein, 146 aa, Artificial Sequence
  Synthetic Protein Sequence
  4B_13E1
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRKKGADLLWCNARISASGYYEKLGFSEQGEVYDIPPIGPHILMYKKLT

SEQ ID NO: 368 - protein, 146 aa, Artificial Sequence
  Synthetic Protein Sequence
  4B_13G10
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPIGPYILMYKKLT

SEQ ID NO: 369 - protein, 146 aa, Artificial Sequence
  Synthetic Protein Sequence
  4B_16E1
MIEVKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPIGPHILMYKKLT

SEQ ID NO: 370 - protein, 146 aa, Artificial Sequence
  Synthetic Protein Sequence
  4B_17A1
MIEVKPINAEDTYEIRHRILRPNQPLEACKYETDLLGGTFHLGGYYRGKLISIASFHQAEHPELEGQKQYQLRGMATLEEYREQKAGSTLIRHAEELLRKKGADLLWCNARTSASGYYEKLGFSEQGEVYDIPPIGPHILMYKKLT

SEQ ID NO: 371 - protein, 146 aa, Artificial Sequence
  Synthetic Protein Sequence
  4B_18F11
MIEVNPINAEDTYEIRHRILRPNQPLEACMYETDLLGGTSHLGGYYRGKLISIASFHNAEHSELDGQKQYQLRGMATLEGYREQKAGSTLIRHAEELLRKKGADLLWCNARTSVSGYYEKLGFSEQGEVYDIPPIGPHISMYKKLT

SEQ ID NO: 372 - protein, 146 aa, Artificial Sequence
  Synthetic Protein Sequence
  4B_19C8
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDIPPIGPHILMYKKLA

SEQ ID NO: 373 - protein, 146 aa, Artificial Sequence
  Synthetic Protein Sequence
  4B_1G4
MIEVKPINAEDTYEIRHRILRPNQPLEACKYETDLLGGAFHLGGYYRGKLISIASFHQSEHPELEGQKQYQLRGMATLEGYRELKAGSTLIRHAEELLRKKGADLLWCNARISASGYYKKLGFSEQGEVYDIPPIGPHILMYKKLT

SEQ ID NO: 374 - protein, 146 aa, Artificial Sequence
  Synthetic Protein Sequence
  4B_21C6
MIEVKPINAEDTYEIRHRILRPNQPLEACMYETDLLGGTFHLGGYYRGKLISIASFHQAEHSELEGQKQYQLRGMATLEEYREQKAGSTLIRHAEELLRKKGADLLWCNARISASGYYKKLGFSEQGGVYDIPPIGPHILMYKKLT

SEQ ID NO: 375 - protein, 146 aa, Artificial Sequence
  Synthetic Protein Sequence
  4B_2H7
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYGIPPIGPHILMYKKLT

SEQ ID NO: 376 - protein, 146 aa, Artificial Sequence
  Synthetic Protein Sequence
  4B_2H8
MIEAKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGEVYDIPPIGPHILMYKKLT

SEQ ID NO: 377 - protein, 146 aa, Artificial Sequence
  Synthetic Protein Sequence
  4B_6D8
MIEVKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEHGEVYDIPPIGPHILMYKKLT

SEQ ID NO: 378 - protein, 146 aa, Artificial Sequence
  Synthetic Protein Sequence
  4B_7E8
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 379 - protein, 146 aa, Artificial Sequence
  Synthetic Protein Sequence
  4C_8C9
MIEVKPINAEDTYEIRHRILRPNQPLEACMYETDLLRGAFHLGGYYRGKLISIASFHQAEHPELEGQKQYQLRGMATLEGYREQKAGSTLIRHAEELLRKKGADLLWCNARTSASGYYEKLGFSEQGEVYDIPPIGPHILMYKKLT

SEQ ID NO: 380 - protein, 146 aa, Artificial Sequence
  Synthetic Protein Sequence
  4H1
MIEVKPINAEDTYEIRHRILRPNQPLEACMYETDLLGGAFHLGGYYQGKLISIASFHQAVHSELEGQKQYQLRGMATLEGYREQKAGSTLIRHAEELLRKKGADLLWCNARTSVSGYYKKLGFSEQGGVYDIPPIGPHILMYKKLT

SEQ ID NO: 381 - protein, 146 aa, Artificial Sequence
  Synthetic Protein Sequence
  6_14D10
MIEVKPINAEDTYEIRHRILRPNQPLEACMYETDLLGGTFHLGGYYRGKLISIASFHQAEHSELEGHKQYQLRGMATLEEYREQKAGSTLIRHAEELLRKKGADLLWCNARTSASGYYKKLGFSEQGGVYDIPPVGPHILMYKKLT

SEQ ID NO: 382 - protein, 146 aa, Artificial Sequence
  Synthetic Protein Sequence
  6_15G7
MIEVKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGEVYDIPPVGPHILMYKKLT

SEQ ID NO: 383 - protein, 146 aa, Artificial Sequence
  Synthetic Protein Sequence
  6_16A5
MIEVKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPVGPHILMYKKLT

SEQ ID NO: 384 - protein, 146 aa, Artificial Sequence
  Synthetic Protein Sequence
  6_16F5
MIEVKPINAEDTYEIRHRILRPNQPLEACMYETDLLGGTFHLGGYYRGKLISIASFHQAVHSELEGQKQYQLRGMATLEGYREQKAGSTLIRHAEELLRKKGADLLWCNARTSASGYYKKLGFSEQGGVYDIPPVGPHILMYKKLT

SEQ ID NO: 385 - protein, 146 aa, Artificial Sequence
  Synthetic Protein Sequence
  6_17C5
MIEVKPINAEDTYEIRHRILRPNQPLEACKYEADLLGGTFHLGGYYRGKLISIASFHQAEHPELEGQKQYQLRGMATLEGNREQKAGSTLIRHAEELLRKKGADLLWCNARTSASGYYKKLGFSEQGEVYDVPPIGPHILMYKKLT

SEQ ID NO: 386 - protein, 146 aa, Artificial Sequence
  Synthetic Protein Sequence
  6_18C7
MIEVKPINAEDTYEIRHRILRPNQPLEACRYETDLLGGTFHLGGYYRGKLISIASFHQAEHPELEGQKQYQLRGMATLEGYREQKAGSTLIRHAEELLRKKGADLLWCNARISASGYYKKLGFSEQGEVYDIPPVGPHILMYKKLT

SEQ ID NO: 387 - protein, 146 aa, Artificial Sequence
  Synthetic Protein Sequence
  6_18D7
  VARIANT 17: Xaa = Any Amino Acid
MIEVKPINAEDTYEIRXRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 388 - protein, 146 aa, Artificial Sequence
  Synthetic Protein Sequence
  6_19A10
MIEAKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 389 - protein, 146 aa, Artificial Sequence
  Synthetic Protein Sequence
  6_19B6
MIEVKPINAEDTYEIRHRILRPNQPLEACMYETDLLRGAFHLGGYYRGKLISIASFHQAEHSELEGQKQYQLRGMATLEGYREQKAGSTLIRHAEELLRKKGADLLWCNARTSASGYYKKLGFSEQGEVYDIPPVGPHILMYKKLT

SEQ ID NO: 390 - protein, 146 aa, Artificial Sequence
  Synthetic Protein Sequence
  6_19C3
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPIGPHILMYKKLT

SEQ ID NO: 391 - protein, 146 aa, Artificial Sequence
  Synthetic Protein Sequence
  6_19C8
MIEVKPINAEDTYEIRHRILRPNQPLEACKYETDLLGGTLHLGGYYRGKLISIASFHQAEHPELEGQKQYQLRGMATLEGYREQKAGSTLIRQAEELLRKKGADLLWCNARTSASGYYKKLGFSEQGGVYDIPPVGPHILMYKELT

SEQ ID NO: 392 - protein, 146 aa, Artificial Sequence
  Synthetic Protein Sequence
  6_20A7
MIEVKPINAEDTYEIRHRILRPNQPLEACMYETDLLRGTFHLGGYYRGKLISIASFHQAEHSDLEGQKQYQLRGMATLEEYREQKAGSTLIRHAEELLRKKGADLLWCNARTSASGYYKKLGFSEQGEVYDIPPVGPHILMYKKLT

SEQ ID NO: 393 - protein, 146 aa, Artificial Sequence
  Synthetic Protein Sequence
  6_20A9
MIEVKPINAGDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPVGPHILMYKKLT

SEQ ID NO: 394 - protein, 146 aa, Artificial Sequence
  Synthetic Protein Sequence
  6_20H5
MIEVKPINAEDTYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGEVYDIPPIGPHILMYKKLT

SEQ ID NO: 395 - protein, 146 aa, Artificial Sequence
  Synthetic Protein Sequence
  6_21F4
MIEVKPINAEDTYEIRHRVLRPNQPLEACMYETDLLGGAFHLGGYYRGKLISIASFHQAEHPELEGQKQYQLRGMATLEGYREQKAGSTLIRHAEELLRKKGADLLWCNARTSASGYYKKLGFSEQGEVYDVPPVGPHILMYKKLT

SEQ ID NO: 396 - protein, 146 aa, Artificial Sequence
  Synthetic Protein Sequence
  6_22C9
MIEVKPINAEDTYEIRHRILRPNRPLEACMYETDLLGGTFHLGGYYRGKLISIASFHQAEHPGLEGKKQYQLRGMATLEEYREQKAGSTLIRHAEELLRKKGADLLWCNARTSASGYYKKLGFSEQGGVYDIPPVGPHILMYKKLT

SEQ ID NO: 397 - protein, 146 aa, Artificial Sequence
  Synthetic Protein Sequence
  6_22D9
MIEVKPINAEDTYEIRHRILRPNQPLEACMYETDLLEGTFHLGGYYRGKLISIASFHQAEHSELEGQKQYQLRGMATLEGYREQKAGSTLIRHAEELLRKKGADLLWCNARTSASGYYKKLGFSEQGEVYDIPPVGPHILMYKKLT

SEQ ID NO: 398 - protein, 146 aa, Artificial Sequence
  Synthetic Protein Sequence
  6_22H9
MIEVKPINAEDTYEIRHRILRPNQPLEACMYETDLLGGTFHLGGYYRGKLISIASFHQAEHSELEGQKQYQLRGMATLDEYREQKAGSTLIRHAEELLRKKGADLLWCNARTSASGYYKKLGFSEQGEVYDIPPIGPHILMYKKLT

SEQ ID NO: 399 - protein, 146 aa, Artificial Sequence
  Synthetic Protein Sequence
  6_23H3
MIEVKPINAEDTYEIRHRILRPNQPLEACMYGTDLLGGTFHLGGYYRGKLISIASFHQAEQPELEGQKQYQLRGMATLEGYREQKAGSTLIRHAEELLRKKGADLLWCNARTSASGYYKKLGFSEQGGVYDIPPVGPHILMYKKLT

SEQ ID NO: 400 - protein, 146 aa, Artificial Sequence
  Synthetic Protein Sequence
  6_23H7
MIEVKPINAEDTYEIRHRILRPNQPLEACMYETDLLGGTFHLGGYYRGKLISIASFHQAEHSELEGQKQYQLRGMATLEGYREQKAGSTLIRHAEEILRKKGADLLWCNARTSASGYYKKLGFSEQGGVYDIPPVGPHILMYKKLT

SEQ ID NO: 401 - protein, 146 aa, Artificial Sequence
  Synthetic Protein Sequence
  6_2H1
MIEVKPINAEDTYEIRHRVLRPNQPLEACMYETDLLGGTFHLGGYYRGKLISIASFHQAEHPELEGQKPYQLRGMATLEGYREQKAGSTLIRHAEELLRKKGADLLWCNARTSASGYYKKLGFSEQGEIYDIPPIGPHILMYKKLT

SEQ ID NO: 402 - protein, 146 aa, Artificial Sequence
  Synthetic Protein Sequence
  6_3D6
MIEIKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 403 - protein, 146 aa, Artificial Sequence
  Synthetic Protein Sequence
  6_3G3
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGEVYDIPPVGPHILMYKKLT

SEQ ID NO: 404 - protein, 146 aa, Artificial Sequence
  Synthetic Protein Sequence
  6_3H2
MIEVKPINAEDTYEIRHRILRPNQPLEACMYETDLLGGTFHLGGYYRGKLISIASFHQAEHPELEGQKQYQLRGMATLEEYREQKAGSTLIRHAEELLRKKGADLLWCNARTSASGYYKKLGFSEQGEVYDIPPVGPHILMYKKLT

SEQ ID NO: 405 - protein, 146 aa, Artificial Sequence
  Synthetic Protein Sequence
  6_4A10
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 406 - protein, 146 aa, Artificial Sequence
  Synthetic Protein Sequence
  6_4B1
MIEVKPINAEDTYEIRHRVLRPNQPLEACMYETDLLGGTFHLGGYYRGKLIGIASFHQAEHPELEGQKQYQLRGMATLEGYREQKAGSTLIRHAEELLRKKGADLLWCNARTSASGYYEKLGFSGQGEVYDIPPIGPHILMYKKLT

SEQ ID NO: 407 - protein, 146 aa, Artificial Sequence
  Synthetic Protein Sequence
  6_5D11
MIEVKPINAEDTYEIRHRILRPNQPLEACMYETDLLGGTFHLGGYYRGKLISIASFHQAEHPELEGQKQYQLRGMATLEEYREQKAGSTLIRHAEELLRKKGADLLWCNARTSASGYYKKLGFSEQGEVYDIPPIGPHILMYKKLT

SEQ ID NO: 408 - protein, 146 aa, Artificial Sequence
  Synthetic Protein Sequence
  6_5F11
MIEVKPINAEDTYEIRHRILRPNQPLEACMYETDLLGGTFHLGGYYRGKLISIASFHQAEHPELEGQKQYQLRGMATLEEYREQKAGSTLIRHAEELLRKKGADLLWCNARTSASGYYKKLGFSEQGEVHDIPPVGPHILMYKKLT

SEQ ID NO: 409 - protein, 146 aa, Artificial Sequence
  Synthetic Protein Sequence
  6_5G9
MIEVKPINAEDTYEIRHRILRPNQPLEACMYETDLLGGTFHLGGYYRGKLISIASFHQAEHSELEGQKQYQLRGMATLEEYREQKAGSTLIRHAEELLRKKGADLLWCNARISASGYYKKLGFSEQGGVYDIPPVGPHILMYKKLT

SEQ ID NO: 410 - protein, 146 aa, Artificial Sequence
  Synthetic Protein Sequence
  6_6D5
MIEVKPINAEDAYEIRHRILRPNQPLEACKYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPVGPHILMYKKLT

SEQ ID NO: 411 - protein, 146 aa, Artificial Sequence
  Synthetic Protein Sequence
  6_7D1
MIEVKPINAEDTYEIRHRILRPNQPLEACMYETDLLRGAFHLGGYYRGKLISIASFHQAEHSELEGQKQYQLRGMATLEGYREQKAGSTLIRHAEELLRKKGADLLWCNARTSASGYYKKLGFSEQGGVYDIPPVGPHILMYKKLT

SEQ ID NO: 412 - protein, 146 aa, Artificial Sequence
  Synthetic Protein Sequence
  6_8H3
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 413 - protein, 146 aa, Artificial Sequence
  Synthetic Protein Sequence
  6_9G11
MIEVKPINAEDTYEIRHRILRPNQPLEACKYETDLLGGTLHLGGYYRGKLISIASFHQAEHSELEGQKQYQLRGMATLEGYREQKAGSTLIRHAEELLRKKGADLLWCNARTSASGYYKKLGFSEQGEVYDIPPVGPHILMYKKLT

SEQ ID NO: 414 - protein, 146 aa, Artificial Sequence
  Synthetic Protein Sequence
  6F1
MIEVKPINAEDTYEIRHRILRPNQPLEACMYETDLLGGTFHLGGYYRGKLVCIASFHKAEHSELEGQKQYQLRGMATLDGYREQKAGSTLIRHAEELLRKKGADLLWCNARTSVSGYYEKLGFSEQGEVYDIPPVGPHILMYKKLT

SEQ ID NO: 415 - protein, 146 aa, Artificial Sequence
  Synthetic Protein Sequence
  7_1C4
MIEVKPINAEDTYEIRHRILRPNQPLEACMYETDLLGGTFHLGGYYRGKLISIASFHQAEHPELEGQKQYQLRGMATLEEYREQKAGSTLIRHAEELLRKKGADLLWCNARTSASGYYKKLGFSEQGGVYDIPPIGPHILMYKKLT

SEQ ID NO: 416 - protein, 146 aa, Artificial Sequence
  Synthetic Protein Sequence
  7_2A10
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGGVYDIPPIGPHILMYKKLT

SEQ ID NO: 417 - protein, 146 aa, Artificial Sequence
  Synthetic Protein Sequence
  7_2A11
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSASGYYKKLGFSEQGGVYDIPPVGPHILMYKKLT

SEQ ID NO: 418 - protein, 146 aa, Artificial Sequence
  Synthetic Protein Sequence
  7_2D7
MIEVKPINAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 419 - protein, 146 aa, Artificial Sequence
  Synthetic Protein Sequence
  7_5C7
MIEVKPINAEDTYEIRHRILRPNQPLEACMYETDLLGGTFHLGGYYRGKLISIASFHQAEHPELEGQKQYQLRGMATLEGYREQKVGSTLIRHAEELLRKKGADLLWCNARTSASGYYKKLGFSEQGGVYDIPPVGPHILMYKKLT

SEQ ID NO: 420 - protein, 146 aa, Artificial Sequence
  Synthetic Protein Sequence
  7_9C9
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPIGPHILMYKKLT

SEQ ID NO: 421 - protein, 146 aa, Artificial Sequence
  Synthetic Protein Sequence
  9_13F10
MIEVKPINAEDTYEIRHRILRPNQPLEACKYETDLLRGAFHLGGYYRGKLVSIASFHQAEHSELEGQKQYQLRGMATLEEYREQKAGSTLIRHAEELLRKKGADLLWCNARTSASGYYKKLGFSEQGEVYDIPPTGPHILMYKKLT

SEQ ID NO: 422 - protein, 146 aa, Artificial Sequence
  Synthetic Protein Sequence
  9_13F1
MIEAKPINAEDTYEIRHRILRPNQPLEACMYETDLLGGTFHLGGYYRGKLVSIASFHQAEHTELEGQKQYQLRGMATLEEYREQKAGSTLIRHAEELLRKKGADLLWCNARTSASGYYKKLGFSEQGEVYDIPPVGPHILMYKKLT

SEQ ID NO: 423 - protein, 146 aa, Artificial Sequence
  Synthetic Protein Sequence
  9_15D5
MIEVKPINAEDTYEIRHRILRPNQPLDACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 424 - protein, 146 aa, Artificial Sequence
  Synthetic Protein Sequence
  9_15D8
MIEVKPINAEDTYEIRHRILRPNQPLEACMYETDLLGGTFHLGGYYRGKLVSIASFHQAEHPELEGQKQYQLRGMATLEGYREQKAGSTLIRHAEALLRKKGADLLWCNARTSASGYYKKLGFSEQGEVYDTPPVGPHILMYKKLT

SEQ ID NO: 425 - protein, 146 aa, Artificial Sequence
  Synthetic Protein Sequence
  9_15H3
MIEVKPINAEDTYEIRHRILRPNQPLEACMYETDMLRGAFHLGGYYRGKLISIASFHQAEHPELEGQKQYQLRGMATLEEYHEQKAGSTLIRHAEELLRKKGADLLWCNARTSASGYYKKLGFSEQGEVYNTPPVGPHILMYKKLT

SEQ ID NO: 426 - protein, 146 aa, Artificial Sequence
  Synthetic Protein Sequence
  9_18H2
MIEVKPINAEDTYEIRHRILRPNQPLEACMYETDLLGGTFHLGGYYRGKLISIASFHQAEHPELVGQKQYQLRGMATLEGYREQKAGSTLIRHAEELLRKKGADLLWCNARTSASGYYKKLGFSEQGEVYDIPPVGPHILMYKKLT

SEQ ID NO: 427 - protein, 146 aa, Artificial Sequence
  Synthetic Protein Sequence
  9_20F12
MIEVKPINAEDTYEIRHRVLRPNQPLEACMYETDLLGGTFHLGGYYRGELVSIASFHQAEHPELEGQKQYQLRGMATLEGYREQKAGSTLIRHAEELLRKKGADLLWCNARTSASGYYKKLGFSEQGGVYDIPPVGPHILMYKKLT

SEQ ID NO: 428 - protein, 146 aa, Artificial Sequence
  Synthetic Protein Sequence
  9_21C8
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSASGYYKKLGFSDQGEVYDIPPVGPHILMYKKLT

SEQ ID NO: 429 - protein, 146 aa, Artificial Sequence
  Synthetic Protein Sequence
  9_22B1
MIEVKPINAEDTYEIRHRILRPNQPLEACKYETDLLGGTFHLGGYYRGKLVSIASFHQAEHPELEGQKQYQLRGMATLEGYREQKAGSTLIRHAEELLRKKGADLLWCNARTSASGYYKKLGFSEQGEVYDLPPTGPHILMYKKLT

SEQ ID NO: 430 - protein, 146 aa, Artificial Sequence
  Synthetic Protein Sequence
  9_23A10
MIEVKPINAEDTYEIRHRILRPNQPLEACKYETDLLGGTLHLGGYYRGKLVSIASFHQAEHPELEGQKQYQLRGMATLEGYRGQKAGSTLIRHAEELLRKKGADLLWCNARTSASGYYKKLGFSEQGGVYDIPPVGPHILMYKKLT

SEQ ID NO: 431 - protein, 146 aa, Artificial Sequence
  Synthetic Protein Sequence
  9_24F6
MIEVKPINAEDTYEIRHRILRPNQPLEACKYETDLLRGAFHLGGYYRGKLISIASFHQAEHSELEGQKQYQLRGMATLEGYREQKAGSTLIRHAEALLRKKGADLLWCNARTSASGYYKKLGFSEQGEVYDIPPTGPHILMYKKLT

SEQ ID NO: 432 - protein, 146 aa, Artificial Sequence
  Synthetic Protein Sequence
  9_4H10
MIEVKPINAEDTYEIRHRILRPNQPLEACKYETDLLGGTLHLGGYYRGKLISIASFHQAEHPELEGQKQYQLRGMATLEGYREQKAGSTLIRHAEELLRKKGADLIWCNARTSASGYYKKLGFSEQGEVYDIPPVGPHILMYKKLT

SEQ ID NO: 433 - protein, 146 aa, Artificial Sequence
  Synthetic Protein Sequence
  9_4H8
MIEVKPINAEDTYEIRHRILRPNQPLEACMYETDLLGGTFHLGGYYRGKLISIASFNQAEHPELEGQKQYQLRGMATLEGYREQKAGSTLIRHAEELLRKKGADLLWCNARTSASGYYKKLGFSEQGEVYDIPPVGPHILMYKKLT

SEQ ID NO: 434 - protein, 146 aa, Artificial Sequence
  Synthetic Protein Sequence
  9_8H1
MIEVKPITAEDTYEIRHRILRPNQPLEACKYETDLLGGTFHLGGYYRGKLISIASFHQAEHPELEGQKQYQLRGMATLEGYREQKAGSTLIRHAEELLRKKGADLLWCNARTSASGYYKKLGFSEQGEVYDIPPTGPHILMYKKLT

SEQ ID NO: 435 - protein, 146 aa, Artificial Sequence
  Synthetic Protein Sequence
  9_9H7
MIEVKPINAEDAYEIRHRILRPNQPLEACKYETDLLGSTFHLGGYYRGKLISIASFHQAEHPELEGQKQYQLRGMATLEEYREQKAGSTLIRHAEELLRKKGADLLWCNARTSASGYYKKLGFSEQGEVYDIPPVGPHILMYKKLT

SEQ ID NO: 436 - protein, 146 aa, Artificial Sequence
  Synthetic Protein Sequence
  9C6
MIEVKPINAEDTYEIRHRILRPNQPLEACMYETDLLGGTFHLGGYYQGKLISIASFHNAEHSELEGQKQYQLRGMATLEGYREQKAGSTLIRHAEELLRKKGADLLWCNARTSVSGYYEKLGFSEQGEVYDIPPVGPHILMYKKLA

SEQ ID NO: 437 - protein, 146 aa, Artificial Sequence
  Synthetic Protein Sequence
  9H11
MIEVKPINAEDTYEIRHRILRPNQPLEACKYETDLLGGTFHLGGYYRGKLISIASFHKAEHSELEGEEQYQLRGMATLEGYREQKAGSTLIRHAEELLRKKGADLLWCNARTSVSGYYKKLGFSEQGEVYDIPPIGPHILMYKKLT

SEQ ID NO: 438 - protein, 146 aa, Artificial Sequence
  Synthetic Protein Sequence
  0_4B10
MIEVKPINAEDTYELRHKILRPNQPIEACMYESDLLRGAFHLGGFYRGKLISIASFHQAEHSDLEGQKQYQLRGMATLEGYRDQKAGSTLIKHAEEILRKRGADMLWCNARTTASGYYKKLGFSEQGEIFDTPPVGPHILMYKRLT

SEQ ID NO: 439 - protein, 146 aa, Artificial Sequence
  Synthetic Protein Sequence
  0_5B11
MIEVKPINAEDTYELRHKILRPNQPIEACMYESDLLRGAFHLGGFYGGKLISIASFHQAEHSDLEGQKQYQLRGMATLEGYRDQKAGSTLIKHAEQLLRKRGADMLWCNARTSASGYYKKLGFSEQGEVFETPPVGPHILMYKKIT

SEQ ID NO: 440 - protein, 146 aa, Artificial Sequence
  Synthetic Protein Sequence
  0_5B3
MLEVKPINAEDTYELRHRILRPNQPIEACMYETDLLRGAFHLGGFYRGKLISIASFHQAEHSELQGQKQYQLRGMATLEGYRDQKAGSSLIKHAEQLLRKRGADLLWCNARTSASGYYKKLGFSEQGEVFDTPPVGPHILMYKRIT

SEQ ID NO: 441 - protein, 146 aa, Artificial Sequence
  Synthetic Protein Sequence
  0_5B4
MLEVKLINAEDTYELRHRILRPNQPLEACMYETDLLRGAFHLGGFYRGKLISIASFHQAEHSDLEGQKQYQLRGMATLEGFRDQKAGSSLIKHAEEILRKRGANLLWCNARTSASGYYKKLGFSEQGEVFDTPPVGPHILMYKRIT

SEQ ID NO: 442 - protein, 146 aa, Artificial Sequence
  Synthetic Protein Sequence
  0_5B8
MIEVKPINAEDTYELRHKILRPNQPIEACMYESDLLRGAFHLGGFYRGKLISIASFHQAEHSDLQGQKQYQLRGMATLEGYRDQKAGSSLIRHAEQILRKRGADLLWCNARTSASGYYKKLGFSEQGEIFDTPPVGPHILMYKRLT

SEQ ID NO: 443 - protein, 146 aa, Artificial Sequence
  Synthetic Protein Sequence
  0_5C4
MIEVKPINAEDTYELRHKILRPNQPLEACMYETDLLRGAFHLGGFYRGKLISIASFHQAEHSGLQGQKQYQLRGMATLEGYREQKAGSSIIKHAEEILRKKGADLLWCNARTSASGYYKKLGFSEQGEIFDTPPVGPHILMYKRIT

SEQ ID NO: 444 - protein, 146 aa, Artificial Sequence
  Synthetic Protein Sequence
  0_5D11
MIEVKPINAEDTYELRHRILRPNQPIEACMYESDLLRGAFHLGGFYRGKLISIASFHQAEHSDLQGQKQYQLRGMATLEGYREQKAGSTLIRHAEQLLRKRGADLLWCNARTSASGYYKRLGFSEQGEVFDTPPVGPHILMYKRLT

SEQ ID NO: 445 - protein, 146 aa, Artificial Sequence
  Synthetic Protein Sequence
  0_5D3
MLEVKPINAEDTYELRHRILRPNQPIEACMYESDLLRGAFHLGGYYRGKLISIASFHQAEHSELQGQKQYQLRGMATLEGYREQKAGSSLIKHAEEILRKRGADLLWCNARTSASGYYKKLGFSEQGEIFETPPVGPHILMYKRIT

SEQ ID NO: 446 - protein, 146 aa, Artificial Sequence
  Synthetic Protein Sequence
  0_5D7
MIEVKPINAEETYELRHRILRPNQPIEACMYETDLLRGAFHLGGFYRGKLISIASFHQAEHSELEGQKQYQLRGMATLEGYRDQKAGSSLIRHAEQLLRKKGANMLWCNARTTASGYYKKLGFSEQGEIFDTPPVGPHILMYKRIT

SEQ ID NO: 447 - protein, 146 aa, Artificial Sequence
  Synthetic Protein Sequence
  0_6B4
MLEVKPINAEDTYELRHRILRPNQPIEACMYESDLLRGALHLGGFYRGKLISIASFHQAEHSDLQGQKQYQLRGMATLEGFRDQKAGSSLIRHAEQILRKRGADLLWCNARTSASGYYKKLGFSEQGKVFDTPPVGPHILMYKRIT

SEQ ID NO: 448 - protein, 146 aa, Artificial Sequence
  Synthetic Protein Sequence
  0_6D10
MLEVKPINAEDTYELRHKILRPNQPLEVCMYETDLLRGAFHLGGFYRGKLISIASFHQAEHSDLQGQKQYQLRGMATLEGYRDQKAGSSLIRHAEQILRKRGADMLWCNARTSASGYYKKLGFSEQGEVFETPPVGPHILMYKRLT

SEQ ID NO: 449 - protein, 146 aa, Artificial Sequence
  Synthetic Protein Sequence
  0_6D11
MIEVKPINAEDTYELRHRILRPNQPIEACMYESDLLRGAFHLGGYYRGKLISIASFHQAEHSDLQGQKQYQLRGMATLEGFRDQKAGSSLIRHAEQILRKRGADLLWCNARTSASGYYKKLGFSEQGEVFETPPVGPHILMYKRIT

SEQ ID NO: 450 - protein, 146 aa, Artificial Sequence
  Synthetic Protein Sequence
  0_6F2
MIEVKPINAEDTYELRHRILRPNQPIEACMYESDLLRGAFHLGGYYRGKLISIASFHQAEHSELQGQKQYQLRGMATLEGFREQKAGSTLIRHAEQILRKRGADMLWCNARTSASGYYKKLGFSEQGEIFDTPPVGPHILMYKRIT

SEQ ID NO: 451 - protein, 146 aa, Artificial Sequence
  Synthetic Protein Sequence
  0_6H9
MIEVKPINAEDTYELRHKILRPNQPIEACMYETDLLRGAFHLGGFYGGKLISIASFHQAEHSDLEGQKQYQLRGMATLEGYREQKAGSTLIRHAEEILRKKGANLLWCNARTSASGYYKKLGFSEQGEVFDTPPVGPHILMYKRLT

SEQ ID NO: 452 - protein, 146 aa, Artificial Sequence
  Synthetic Protein Sequence
  10_4C10
  VARIANT 45, 105: Xaa = Any Amino Acid
MIEVKPINAEDTYELRHKILRPNQPLEVCMYETDLLRGAFHLGGXYRGKLISIASFHQAEHSELQGQKQYQLRGMATLEGYRDQKAGSSLIKHAEQILRKRGADXLWCNARTSASGYYKKLGFSEQGEIFDTPPVGPHILMYKRLT

SEQ ID NO: 453 - protein, 146 aa, Artificial Sequence
  Synthetic Protein Sequence
  10_4D5
MIEVKPINAEDTYELRHRILRPNQPIEVCMYETDLLRGAFHLGGFYRGKLISIASFHQAEHSDLQGQKQYQLRGMATLEGYREQKAGSTLIRHAEQILRKRGADLLWCNARTSASGYYKKLGFSEQGEVFDTPPVGPHILMYKRIT

SEQ ID NO: 454 - protein, 146 aa, Artificial Sequence
  Synthetic Protein Sequence
  10_4F2
MLEVKPINAEDTYELRHRILRPNQPIEACMFESDLLRGAFHLGGFYRGKLISIASFHQAEHSELQGQKQYQLRGMATLEGYREQKAGSSLIRHAEEILRKRGADMLWCNARTSASGYYKKLGFSEQGEIFETPPVGPHILMYKRLT

SEQ ID NO: 455 - protein, 146 aa, Artificial Sequence
  Synthetic Protein Sequence
  10_4F9
MIEVKPINAEDTYELRHRILRPNQPIEVCMYETDLLRGAFHLGGFYRGKLISIASFHQAEHSELQGQKQYQLRGMATLEGFREQKAGSSLIRHAEQILRKRGADLLWCNARTSASGYYKKLGFSEQGEIFDTPPVGPHILMYKRLT

SEQ ID NO: 456 - protein, 146 aa, Artificial Sequence
  Synthetic Protein Sequence
  10_4G5
MIEVKPINAEDTYELRHRILRPNQPIEACMFESDLLRGAFHLGGYYRGKLISIASFHQAEHSDLQGQKQYQLRGMATLEGYRDQKAGSSLIRHAEQILRKRGADLLWCNARTSASGYYKKLGFSEQGEIFDTPPVGPHILMYKRLT

SEQ ID NO: 457 - protein, 146 aa, Artificial Sequence
  Synthetic Protein Sequence
  10_4H4
MLEVKPINAEDTYELRHKILRPNQPLEVCMYETDLLRGAFHLGGFYRGKLISIASFHQAEHSELQGQKQYQLRGMATLEGYREQKAGSSLIKHAEEILRKRGADLLWCNARTSASGYYKKLGFSEQGEVFDTPPVGPHILMYKRIT

SEQ ID NO: 458 - protein, 146 aa, Artificial Sequence
  Synthetic Protein Sequence
  11_3A11
MIEVKPINAEDTYELRHKILRPNQPIEVCMYESDLLRGAFHLGGFYRGKLISIASFHQAEHPDLQGQKQYQLRGMATLEGYRDQKAGSSLIKHAEQILRKRGADLLWCNARTSASGYYKKLGFSEQGEVFETPPVGPHILMYKRLT

SEQ ID NO: 459 - protein, 146 aa, Artificial Sequence
  Synthetic Protein Sequence
  11_3B1
MLEVKPINAEDTYELRHRILRPNQPIEACMFETDLLRGAFHLGGFYRGKLISIASFHQAEHSDLQGQKQYQLRGMATLEGFREQKAGSTLIRHAEEILRKRGADLLWCNARTSASGYYKRLGFSEQGEIFDTPPVGPHILMYKRLT

SEQ ID NO: 460 - protein, 146 aa, Artificial Sequence
  Synthetic Protein Sequence
  11_3B5
MIEVKPINAEDTYELRHRILRPNQPIEACMFESDLLRGAFHLGGYYRGKLISIASFHQAEHSELQGQKQYQLRGMATLEGYRDQKAGSSLIRHAEQILRKRGADMLWCNARTSASGYYKKLGFSEQGEVFDTPPVGPHILMYKRIT

SEQ ID NO: 461 - protein, 146 aa, Artificial Sequence
  Synthetic Protein Sequence
  11_3C12
MIEVKPINAEDTYELRHRILRPNQPLEVCMYETDLLRGAFHLGGFYGGKLISIASFHQAEHPDLQGQKQYQLRGMATLEGYRDQKAGSSLIRHAEQLLRKRGADLLWCNARTSASGYYKKLGFSEQGEIFETPPVGPHILMYKRIT

SEQ ID NO: 462 - protein, 146 aa, Artificial Sequence
  Synthetic Protein Sequence
  11_3C3
MIEVKPINAEDTYELRHKILRPNQPIEACMYESDLLRGALHLGGYYRGKLISIASFHQAEHSELQGQKQYQLRGMATLEGYREQKAGSSLIKHAEEILRKRGADLLWCNARTSASGYYKKLGFSEQGEVFDTPPVGPHILMYKRIT

SEQ ID NO: 463 - protein, 146 aa, Artificial Sequence
  Synthetic Protein Sequence
  11_3C6
MLEVKPINAEDTYELRHKILRPNQPIEACMFESDLLRGAFHLGGFYGGKLISIASFHQAEHSDLEGQKQYQLRGMATLEGYREQKAGSTLIRHAEEILRKRGADLLWCNARTSASGYYKKLGFSEQGEIFDTPPVGPHILMYKRIT

SEQ ID NO: 464 - protein, 146 aa, Artificial Sequence
  Synthetic Protein Sequence
  11_3D6
MIEVKPINAEDTYELRHRILRPNQPIEVCMYETDLLRGAFHLGGFYRGKLISIASFHQAEHSDLQGQKQYQLRGMATLEGYREQKAGSSLIKHAEQILRKRGADLLWCNARTSASGYYKKLGFSEQGEVFDTPPVGPHILMYKRLT

SEQ ID NO: 465 - protein, 146 aa, Artificial Sequence
  Synthetic Protein Sequence
  1_1G12
MLEVKPINAEDTYELRHRILRPNQPIEVCMYETDLLRGAFHLGGFYGGKLISIASFHQAEHSELQGQKQYQLRGMATLEGYRDQKAGSSLIKHAEEILRKRGADLLWCNARTSASGYYKKLGFSEQGEVFETPPVGPHILMYKRLT

SEQ ID NO: 466 - protein, 146 aa, Artificial Sequence
  Synthetic Protein Sequence
  1_1H1
MIEVKPINAEETYELRHKILRPNQPIEACMYESDLLRGSFHLGGFYRGQLISIASFHKAEHSELQGQKQYQLRGMATLEGFREQKAGSSLIRHAEEILRNKGADLLWCNARTTASGYYKRLGFSEHGEVFETPPVGPHILMYKRIT

SEQ ID NO: 467 - protein, 146 aa, Artificial Sequence
  Synthetic Protein Sequence
  1_1H2
MIEVKPINAEDTYELRHRILRPNQPLEACMYESDLLRGSFHLGGFYRGKLISIASFHQAEHSELEGQKQYQLRGMATLEGFREQKAGSSLIRHAEEILRKRGADLLWCNARTTAAGYYKKLGFSEQGEIFDTPPVGPHILMYKRIT

SEQ ID NO: 468 - protein, 146 aa, Artificial Sequence
  Synthetic Protein Sequence
  1_1H5
MIEVKPINAEDTYEIRHRILRPNQPLEACMYESDLLRGSFHLGGFYRGKLISIASFHQAEHSDLEGQKQYQLRGMATLEGYRDQKAGSSLIRHAEQILRKRGADLLWCNARTTAAGYYKRLGFSEQGEVFDTPPVGPHILMYKKLT

SEQ ID NO: 469 - protein, 146 aa, Artificial Sequence
  Synthetic Protein Sequence
  1_2A12
MIEVKPINAEDTYELRHRILRPNQPIEACMYESDLLRGSFHLGGFYRGKLISIASFHQAEQSELEGQKQYQLRGMATLEGYRDQKAGSTLIKHAEEILRKKGADLLWCNARTSAAGYYKRLGFSEQGEIFDTPPVGPHILMYKRLT

SEQ ID NO: 470 - protein, 146 aa, Artificial Sequence
  Synthetic Protein Sequence
  1_2B6
MIEVKPINAEETYELRHKILRPNQPLEACMYETDLLRGSFHLGGFYRGKLISIASFHQAEHSELEGQKQYQLRGMATLEGFRDQKAGSSLIKHAEEILRKRGADLLWCNARTSASGYYKKLGFSEQGEIFETPPVGPHILMYKRLT

SEQ ID NO: 471 - protein, 146 aa, Artificial Sequence
  Synthetic Protein Sequence
  1_2C4
MLEVKPINAEETYELRHKILRPNQPIEACMYETDLLRGSFHLGGFYRGQLISIASFHQAEHSDLQGQKQYQLRGMATLEGYREQKAGSTLIKHAEELLRKKGADLLWCNARTTAAGYYKKLGFSEQGEVFDTPPVGPHILMYKKIT

SEQ ID NO: 472 - protein, 146 aa, Artificial Sequence
  Synthetic Protein Sequence
  1_2D2
MIEVKPINAEDTYELRHKILRPNQPLEACMYESDLLRSAFHLGGFYRGKLISIASFHKAEHSELQGQKQYQLRGMATLEGYRDQKAGSSLIRHAEEILRKRGADMLWCNARTSAAGYYKRLGFSEQGEVFDTPPVGPHILMYKRIT

SEQ ID NO: 473 - protein, 146 aa, Artificial Sequence
  Synthetic Protein Sequence
  1_2D4
MIEVKPINAEDTYELRHRILRPNQPIEACMYESDLLRGSFHLGGFYRGKLISIASFHQAEHSDLQGQKQYQLRGMATLEGYREQKAGSSLIKHAEQLLRKKGADMLWCNARTSAAGYYKRLGFSEHGEIFETPPVGPHILMYKRIT

SEQ ID NO: 474 - protein, 146 aa, Artificial Sequence
  Synthetic Protein Sequence
  1_2F8
MLEVKPINAEDTYELRHRILRPNQPLEACMYETDLLRGSFHLGGFYRGKLISIASFHQAEHSELEGQKQYQLRGMATLEGYRDQKAGSSLIRHAEEILRKRGADMLWCNARTTAAGYYKKLGFSEQGEIYDTPPVGPHILMYKKLT

SEQ ID NO: 475 - protein, 146 aa, Artificial Sequence
  Synthetic Protein Sequence
  1_2H8
MIEVKPINAEETYELRHKILRPNQPLEACMYETDLLRGAFHLGGFYRGKLISIASFHQADHSELQGQKQYQLRGMATLEGYREQKAGSTLIRHAEQILRKRGADLLWCNARTSAAGYYKKLGFSEHGEIFETPPVGPHILMYKRLT

SEQ ID NO: 476 - protein, 146 aa, Artificial Sequence
  Synthetic Protein Sequence
  1_3A2
MIEVKPINAEDTYELRHRILRPNQPIEACMYESDLLRGAFHLGGFYRGKLISIASFHQAEHSDLQGQKQYQLRGMATLEGYREQKAGSSLIRHAEEILRKKGADMLWCNARTTAAGYYKRLGFSEQGEVFDTPPVGPHILMYKRIT

SEQ ID NO: 477 - protein, 146 aa, Artificial Sequence
  Synthetic Protein Sequence
  1_3D6
MIEVKPINAEDTYELRHKILRPNQPIEACMYESDLLQGSFHLGGFYRGQLISIASFHQAEHSDLQGQKQYQLRGMATLEGFREQKAGSTLIKHAEEILRKKGADLLWCNARTSAAGYYKKLGFSEHGEIFDTPPAGPHILMYKKLT

SEQ ID NO: 478 - protein, 146 aa, Artificial Sequence
  Synthetic Protein Sequence
  1_3F3
MIEVKPINAEETYELRQRILRPNQPIEACMYESDLLRGSFHLGGFYRGQLISIASFHQAEHSELQGQKQYQLRGMATLEGYREQKAGSTLIKHAEEILRKKGADLLWCNARTSAAGYYKRLGFSEHGEIFDTPPVGPHILMYKRIT

SEQ ID NO: 479 - protein, 146 aa, Artificial Sequence
  Synthetic Protein Sequence
  1_3H2
MIEVKPINAEDTYELRHRILRPNQPIEACMYETDLLRGAFHLGGYYRGQLISIASFHKAEHSELQGQKQYQLRGMATLEGYREQKAGSTLIKHAEQLLREKGADMLWCNARTSAAGYYKRLGFSEQGEVFDTPPVGPHILMYKKLT

SEQ ID NO: 480 - protein, 146 aa, Artificial Sequence
  Synthetic Protein Sequence
  1_4C5
MIEVKPINAEDTYELRHKILRPNQPIEACMYESDLLRGSFHLGGFYRGKLISIASFHKAEHSDLEGQNQYQLRGMATLEGYREQKAGSTLIRHAEEILRKRGADMLWCNARTSASGYYKRLGFSEHGEIFDTPPVGPHILMYKRLT

SEQ ID NO: 481 - protein, 146 aa, Artificial Sequence
  Synthetic Protein Sequence
  1_4D6
MLEVKPINAEDTYELRHRILRPNQPIEACMYETDLLRGSFHLGGFYRGQLISIASFHKAEHSDLEGQKQYQLRGMATLEGYREQKAGSTLIRHAEQILRKRGADMLWCNARTSAAGYYKRLGFSEQGEVFETPPVGPHILMYKRLT

SEQ ID NO: 482 - protein, 146 aa, Artificial Sequence
  Synthetic Protein Sequence
  1_4H1
MIEVKPINAEDTYELRHRILRPNQPLEACMYETDLLRGSFHLGGFYRGKLISIASFHQAEHSDLQGQKQYQLRGMATLEGYREQKAGSTLIRHAEQLLRKRGADLLWCNARTSASGYYKRLGFSEHGEVFDTPPVGPHILMYKRLT

SEQ ID NO: 483 - protein, 146 aa, Artificial Sequence
  Synthetic Protein Sequence
  1_5H5
MLEVKPINAEETYELRHKILRPNQPLEACMYESDLLRGSFHLGGYYRGQLISIASFHQAEHSELEGQKQYQLRGMATLEGFREQKAGSTLIKHAEQILRKRGADMLWCNARTSAAGYYKKLGFSEHGEIFDTPPVGPHILMYKKLT

SEQ ID NO: 484 - protein, 146 aa, Artificial Sequence
  Synthetic Protein Sequence
  1_6F12
MIEVKPINAEETYELRHRILRPNQPIEACMYESDLLRGSFHLGGFYRGKLISIASFHQAEHSDLEGQKQYQLRGMATLEGYRDQKAGSTLIKHAEELLRKRGADMLWCNARTSAAGYYKRLGFSEHGEIYETPPVGPHILMYKKIT

SEQ ID NO: 485 - protein, 146 aa, Artificial Sequence
  Synthetic Protein Sequence
  1_6H6
MIEVKPINAEDTYELRHKILRPNQPIEACMYESDLLRGSFHLGGFYRGQLISIASFHQAEHSDLEGQKQYQLRGMATLEGYRDQKAGSSLIKHAEEILRKRGADLLWCNARTSAAGYYKRLGFSEQGEIFDTPPVGPHILMYKKIT

SEQ ID NO: 486 - protein, 146 aa, Artificial Sequence
  Synthetic Protein Sequence
  3_11A10
MLEVKPINAEDTYELRHRILRPNQPIEACMYESDLLRGAFHLGGYYRGKLISIASFHQAEHSELQGQKQYQLRGMATLEGYREQKAGSSLVKHAEEILRKRGADLLWCNARTSASGYYKKLGFSEQGEIFETPPVGPHILMYKRIT

SEQ ID NO: 487 - protein, 146 aa, Artificial Sequence
  Synthetic Protein Sequence
  3_14F6
MLEVKPINAEDTYELRHRILRPNQPIEACMYESDLLRGAFHLGGFYRGKLISIASFHQAEHSELQGQKQYQLRGMATLEGYREQKAGSSLIKHAEEILRKRGADLLWCNARTSASGYYKKLGFSEQGEIFETPPVGPHILMYKRLT

SEQ ID NO: 488 - protein, 146 aa, Artificial Sequence
  Synthetic Protein Sequence
  3_15B2
MLEVKPINAEDTYELRHKILRPNQPLEVCMYETDLLRGAFHLGGYYGGKLISIASFHQAEHSELQGQKQYQLRGMATLEGYREQKAGSSLIKHAEEILRKRGADLLWCNARTSASGYYKKLGFSEQGEIFETPPVGPHILMYKRIT

SEQ ID NO: 489 - protein, 146 aa, Artificial Sequence
  Synthetic Protein Sequence
  3_6A10
MIEVKPINAEDTYELRHRILRPNQPIEACMYESDLLRGAFHLGGYYRGKLISIASFHQAEHSELQGQKQYQLRGMATLEGYREQKAGSSLIKHAEEILRKRGADLLWCNARTSASGYYKKLGFSEQGEIFETPPVGPHILMYKRIT

SEQ ID NO: 490 - protein, 146 aa, Artificial Sequence
  Synthetic Protein Sequence
  3_6B1
MLEVKPINAEDTYELRHRILRPNQPIEACMYESDLLRGAFHLGGYYRGKLISIASFHQAEHPELQGQKQYQLRGMATLEGYREQKAGSSLIKHAEEILRKRGADLLWCNARTSASGYYKKLGFSEQGEVFETPPVGPHILMYKRIT

SEQ ID NO: 491 - protein, 146 aa, Artificial Sequence
  Synthetic Protein Sequence
  3_7F9
MLEVKPINAEDTYELRHRILRPNQPIEACMYESDLLRGAFHLGGYYGGKLISIASFHQAEHSDLQGQKQYQLRGMATLEGYREQKAGSSLIKHAEEILRKRGADLLWCNARTSASGYYKKLGFSEQGEIFETPPVGPHILMYKRIT

SEQ ID NO: 492 - protein, 146 aa, Artificial Sequence
  Synthetic Protein Sequence
  3_8G11
MLEVKPINAEDTYELRHRILRPNQPIEVCMYESDLLRGAFHLGGYYRGKLISIASFHQAEHSELQGQKQYQLRGMATLEGYREQKAGSSLIKHAEEILRKRGADLLWCNARTSASGYYKKLGFSEQGEIFETPPVGPHILMYKRIT

SEQ ID NO: 493 - protein, 146 aa, Artificial Sequence
  Synthetic Protein Sequence
  4_1B10
MIEVKPINAEDTYELRHRILRPNQPIEVCMYETDLLRGAFHLGGFYGGKLISIASFHQAEHSDLQGQKQYQLRGMATLEGYRDQKAGSSLIRHAEQILRKRGADMLWCNARTSASGYYKKLGFSEQGEIFETPPVGPHILMYKRIT

SEQ ID NO: 494 - protein, 146 aa, Artificial Sequence
  Synthetic Protein Sequence
  5_2B3
MIEVKPINAEDTYELRHRILRPNQPLEVCMYETDLLRGAFHLGGFYGGKLISIASFHQAEHSDLQGQKQYQLRGMATLEGYRDQKAGSSLIRHAEQILRKRGADMLWCNARTSASGYYKKLGFSEQGEIFETPPVGPHILMYKRIT

SEQ ID NO: 495 - protein, 146 aa, Artificial Sequence
  Synthetic Protein Sequence
  5_2D9
  VARIANT 3, 26, 33: Xaa = Any Amino Acid
MLXVKPINAEDTYELRHKILRPNQPXEVCMYEXDLLRGAFHLGGFYRGKLISIASFHQAEHSDLQGQKQYQLRGMATLEGYRDQKAGSSLIKHAEQILRERGADMLWCNARTSASGYYKKLGFSEQGEVFDTPPVGPHILMYKRLT

SEQ ID NO: 496 - protein, 146 aa, Artificial Sequence
  Synthetic Protein Sequence
  5_2F10
MLEVKPINAEDTYELRHKILRPNQPIEVCMYETDLLRGAFHLGGFYGGKLISIASFHQAEHSDLQGQKQYQLRGMATLEGYRDQKAGSSLIRHAEQILRKRGADMLWCNARTSASGYYKKLGFSEQGEIFETPPVGPHILMYKRLT

SEQ ID NO: 497 - protein, 146 aa, Artificial Sequence
  Synthetic Protein Sequence
  6_1A11
MLEVKPINAEDTYELRHKILRPNQPLEVCMYETDLLRGAFHLGGFYRGKLISIASFHQAEHSDLQGQKQYQLRGMATLEGYRDQKAGSSLIRHAEQILRKRGADMLWCNARTSASGYYRKLGFSEQGEVFETPPVGPHILMYKRLT

SEQ ID NO: 498 - protein, 146 aa, Artificial Sequence
  Synthetic Protein Sequence
  6_1D5
MIEVKPINAEDTYELRHKILRPNQPLEVCMYETDLLRGAFHLGGFYRGKLISIASFHQAEHSDLQGQKQYQLRGMATLEGYRDQKAGSSLIRHAEQILRKRGADMLWCNARTSASGYYKKLGFSEQGEVFETPPVGPHILMYKRIT

SEQ ID NO: 499 - protein, 146 aa, Artificial Sequence
  Synthetic Protein Sequence
  6_1F11
MIEVKPINAEDTYELRHKILRPNQPLEVCMYETDLLRGAFHLGGFYRGKLISIASFHQAEHSDLQGQKQYQLRGMATLEGYREQKAGSSLIRHAEQILRKRGADMLWCNARTSASGYYKKLGFSEQGEVFETPPVGPHILMYKRLT

SEQ ID NO: 500 - protein, 146 aa, Artificial Sequence
  Synthetic Protein Sequence
  6_1F1
MLEVKPINAEDTYELRHKILRPNQPLEVCMYETDLLRGAFHLGGFYRGKLISIASFHQAEHSELQGQKQYQLRGMATLEGYRDQKAGSSLIRHAEQILRKRGADMLWCNARTSASGYYKKLGFSEQGEVFETPPVGPHILMYKRLT

SEQ ID NO: 501 - protein, 146 aa, Artificial Sequence
  Synthetic Protein Sequence
  6_1H10
MLEVKPINAEDTYELRHKILRPNQPLEVCMYETDLLRGAFHLGGFYGGKLISIASFHQAEHSDLQGQKQYQLRGMATLEGYRDQKAGSSLIRHAEEILRKRGADMLWCNARTSASGYYKKLGFSEQGEVFDTPPVGPHILMYKKIT

SEQ ID NO: 502 - protein, 146 aa, Artificial Sequence
  Synthetic Protein Sequence
  6_1H4
MLEVKPINAEDTYELRHKILRPNQPLEVCMYETDLLRGAFHLGGFYGGKLISIASFHQAEHSDLQGQKQYQLRGMATLEGYRDQKAGSTLIKHAEQILRKRGADMLWCNARTSASGYYKKLGFSEQGEVFETPPVGPHILMYKRLT

SEQ ID NO: 503 - protein, 146 aa, Artificial Sequence
  Synthetic Protein Sequence
  8_1F8
MIEVKPINAEDTYELRHRILRPNQPLEVCMYETDLLRGAFHLGGFYRGKLISIASFHQAEHSDLQGQKQYQLRGMATLEGYREQKAGSSLIKHAEEILRKRGADLLWCNARTSASGYYKKLGFSEQGEIFDTPPVGPHILMYKRIT

SEQ ID NO: 504 - protein, 146 aa, Artificial Sequence
  Synthetic Protein Sequence
  8_1G2
MIEVKPINAEDTYELRHRVLRPNQPLEVCMYETDLLRGAFHLGGYYRGKLISIASFHQAEHSELQGQKQYQLRGMATLEGYREQKAGSSLIKHAEEILRKRGADLLWCNARTSASGYYKKLGFSEQGEVFETPPVGPHILMYKRLT

SEQ ID NO: 505 - protein, 146 aa, Artificial Sequence
  Synthetic Protein Sequence
  8_1G3
MLEVKPINAEDTYELRHKILRPNQPIEVCMYETDLLRGAFHLGGYYRGKLISIASFHQAEHSELQGQKQYQLRGMATLEGYREQKAGSSLIRHAEEILRKRGADLLWCNARTSASGYYKKLGFSEQGEIFDTPPVGPHILMYKRIT

SEQ ID NO: 506 - protein, 146 aa, Artificial Sequence
  Synthetic Protein Sequence
  8_1H7
MLEVKPINAEDTYELRHRILRPNQPIEVCMYETDLLRGAFHLGGFYRGKLISIASFHQAEHSELQGQKQYQLRGMATLEGYREQKAGSSLIKHAEEILRKRGADMLWCNARTSASGYYKKLGFSEQGEIFETPPVGPHILMYKRLT

SEQ ID NO: 507 - protein, 146 aa, Artificial Sequence
  Synthetic Protein Sequence
  8_1H9
MLEVKPINAEDTYELRHKILRPNQPLEVCMYETDLLRGAFHLGGYYRGKLISIASFHQAEHSDLQGQKQYQLRGMATLEGYREQKAGSSLIRHAEEILRKRGADLLWCNARTSASGYYKKLGFSEQGEVFDTPPVGPHILMYKRLT

SEQ ID NO: 508 - protein, 146 aa, Artificial Sequence
  Synthetic Protein Sequence
  GAT1_21F12
MIEVKPINAEDTYEIRHRILRPNQPLEACKYETDLLGGTFHLGGYYRGKLISIASFHNAEHSELEGQKQYQLRGMATLEGYREQKAGSTLIRHAEELLRKKGADLLWCNARTSVSGYYKKLGFSEQGEVYDIPPIGPHILMYKKLT

SEQ ID NO: 509 - protein, 146 aa, Artificial Sequence
  Synthetic Protein Sequence
  GAT1_24G3
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTFVSGYYEKLGFSEQGEVYDIPPIGPYILMYEKLT

SEQ ID NO: 510 - protein, 146 aa, Artificial Sequence
  Synthetic Protein Sequence
  GAT1_29G1
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSVSGYYKKLGFSEQGGVCDIPPIGPHILMYKKLA

SEQ ID NO: 511 - protein, 146 aa, Artificial Sequence
  Synthetic Protein Sequence
  GAT1_32G1
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSVSGYYEKLGFSEQGEVYDIPPIGPHILMYKKLT

SEQ ID NO: 512 - protein, 146 aa, Artificial Sequence; identical to SEQ ID NO: 508
  Synthetic Protein Sequence
  GAT2_15G8

SEQ ID NO: 513 - protein, 146 aa, Artificial Sequence
  Synthetic Protein Sequence
  GAT2_19H8
MIEVKPINAEDTYEIRHRILRPNQPLEACMYETDLLGGTFHLGGYYRGKLISIASFHQAEHPELEGQKQYQLRGMATLEGYREQKAGSTLIRHAEELLRKKGADLLWCNARTSVSGYYEKLGFSEQGEVCDIPPIGPHILMYKKLT

SEQ ID NO: 514 - protein, 146 aa, Artificial Sequence
  Synthetic Protein Sequence
  GAT2_21F1
MIEVKPINAEDTYEIRHRILRPNQPLEACMYETDLLGGTFHLGGYYRGKLISIASFHQAEHSELEGQKQYQLRGMATLEGYREQKAGSTLIRHAEELLRKKGADLLWCNARTSVSGYYKKLGFSEQGGVYDIPPIGPHILMYKKLT

SEQ ID NO: 515 - DNA, 18 bp, Artificial Sequence
  Synthetic nucleic acid sequence
  RBS (0)...(0): B. licheniformis ribosome binding site
aactgaaggaggaatctc

SEQ ID NO: 516 - DNA, 441 bp, Artificial Sequence
  Synthetic nucleic acid sequence
  GY12_7G1
atgattgaggtgaaaccgattaacgcagaggatacctatgaactaaggcataggatactcagaccaaaccagccgatagaggtttgtatgtatgaaaccgatttacttcgtggtgcgtttcacttaggcggcttttacaggggcaagctgatttccatagcttcattccaccaggccgagcattcagatctcgagggccagaaacaataccaactccgaggtatggctaccttggaaggttatcgtgaacagaaagcgggatcgaccctaattcaacacgctgaacagatccttcggaagcggggggcggacatgctatggtgcaatgcgcggacaaccgccgctggctactacaaaaagttaggcttcagcgagcagggagaggtatttgatacgccgccagtaggacctcacatcctaatgtataaacgcctcacataa

SEQ ID NO: 517 - DNA, 441 bp, Artificial Sequence
  Synthetic nucleic acid sequence
  GY12_5A11
atgattgaagtgaaaccgattaacgcagaggatacctatgaactaaggcataggatactcagaccaaaccagccgatagaggtttgtatgtatgaaagcgatttacttcgtggtgcgtttcacttaggcggcttttacaggggcaagctgatttccatagcttcattccaccaggccgagcattcagaactccagggccagaaacaataccaactccgaggtatggctaccttggaaggttatcgtgaccagaaagcgggatcgagcctaattagacacgctgaacagatccttcggaagcggggggcggacatgctatggtgcaatgcgcggacatccgcctctggctactacaaaaagttaggcttcagtgagcagggagaggtatttgatacgccgccagtaggacctcacatcctaatgtataaacgcatcacataa

SEQ ID NO: 518 - DNA, 441 bp, Artificial Sequence; identical to SEQ ID NO: 128
  Synthetic nucleic acid sequence
  GY12_4H12

SEQ ID NO: 519 - DNA, 441 bp, Artificial Sequence
  Synthetic nucleic acid sequence
  D_S00218358_B-2A3
atgatagaagtgaaacctattaacgcagaggagacttacgaacttcgacacaagatcctgcgccctaatcagccgatagaggtatgcatgtatgaaagcgatctgctgcggggctcgttccatttgggcgggttctatcgtggccaattgatctcgattgcgagtttccacaaagctgaacacccagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataaaaggcttggtttttgtgagcacggcgaagttttcgaaaccccgccggttgggccgcacattcttatgtacaaaaaactcacttaa

SEQ ID NO: 520 - DNA, 441 bp, Artificial Sequence
  Synthetic nucleic acid sequence
  D_S00218372_B-2B5
atgatagaagtgaaacctattaacgcagaggagacttacgaacttcgacacaagatcctgcgccctaatcagccgatagaggtatgcatgtatgaaagcgatctgctgcggggctcgttccatttgggcgggttctatcgtggccaattgatctcgattgcgagtttccacaaagctgaacacccagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataaaaggcttggttttagtgagcacggcgaagttttcgaaaccccgccggttgggccgcacattcttatgtacaaaagaatcacttaa

SEQ ID NO: 521 - DNA, 441 bp, Artificial Sequence
  Synthetic nucleic acid sequence
  D_S00218373_B-2B6
atgatagaagtgaaacctattaacgcagaggagacttacgaacttcgacacaagatcctgcgccctaatcagccgatagaggcatgcatgtatgaaagcgatctgctgcggggctcgttccatttgggcgggttctatcgtggccaattgatctcgattgcgagtttccacaaagctgaacactcagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataaaaggcttggttttagtgagcacggcgaagttttcgaaaccccgccggttgggccgcacattcttatgtacaaaaaactcacttaa

SEQ ID NO: 522 - DNA, 441 bp, Artificial Sequence
  Synthetic nucleic acid sequence
  D_S00267061_B-3B8
atgatagaagtgaaacctattaacgcagaggagacttacgaacttcgacacaagatcctgcgccctaatcagccgatagaggtatgcatgtatgaaagcgatctgctgcggggctcgttccatttgggcgggttctatcgtggccaattgatctcgattgcgagtttccacaaagctgaacactcagaactgcaagggcaaaagcagtatcaattacgagggatggcgaccctcgaaggattccgtgagcagaaggctggctcttcgcttattaggcatgccgaggagatactacggaataaaggggcagatctgctttggtgtaatgcacgcacgacagcctccggttactataaaaggcttggttttagtgagcacggcgaagttttcgaaaccccgccggttgggccgcacattcttatgtacaaaagaatcacttaa

SEQ ID NO: 523 - DNA, 440 bp, Artificial Sequence
  Synthetic nucleic acid sequence
  D_S00218516_B-3H5
atgatagaagtgaaacctattaacgcagaggagacttacgaacttcgacacaagatcctgcgccctaatcagccgatagaggcatgcatgtatgaaagcgatctgctgcggggctcgttccatttgggcgggttctatcgtggccaattgatctcgattgcgagtttcaacaaagctgaacactcagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataaaaggcttggttttagtgagcacggcgaagttttcgaaaccccgccggttgggccgcacattcttatgtacaaaagaatcactta

SEQ ID NO: 524 - DNA, 441 bp, Artificial Sequence
  Synthetic nucleic acid sequence
  D_S00218540_B-4B5
atgatagaagtgaaacctattaacgcagaggagacttacgaacttcgacacaagatcctgcgccctaatcagccgatagaggtatgcatgtatgaaaccgatctgctgcggggctcgttccatttgggcgggttctatcgtggccaattgatctcgatcgcgagtttccacaaagctgaacactcagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataaaagacttggttttagtgagcacggcgaagttttcgaaaccccgccggttgggccgcacattcttatgtacaaaaaactcacttaa

SEQ ID NO: 525 - DNA, 441 bp, Artificial Sequence
  Synthetic nucleic acid sequence
  D_S00218549_B-4C2
atgatagaagtgaaacctattaacgcagaggagacttacgaacttcgacacaagatcctgcgccctaatcagccgatagaggtatgcatgtatgaaagcgatctgctgcggggcgcgttccatttgggcgggttctatcgtggccaattgatctcgattgcgagtttccacaaagctgagcaccctgaactgcaagggcaaaagcagtatcaattacgagggatggcgaccctcgaaggattccgtgagcagaaggctggctcttcgcttattaggcacgccgaggagatactacggaatagaggggcagatctgctttggtgtaatgcacgcacgacagcctccggttactataaaaggcttggttttagtgagcacggcgaagttttcgaaaccccgccggttgggccgcacattcttatgtacaaaagaatcacttaa

SEQ ID NO: 526 - DNA, 441 bp, Artificial Sequence
  Synthetic nucleic acid sequence
  D_S00267186_B-4G1
atgatagaagtgaaacctattaacgcagaggagacttacgaacttcgacacaagatcctgcgccctaatcagccgatagaggtatgcatgtatgaaagcgatctgctgcggggcgcgttccatttgggcgggttctatcgtggccaattgatctcgattgcgagtttccacaaagctgaacacccagaactgcaagggcaaaagcagtatcaattacgagggatggcgaccctcgaaggattccgtgagcagaaggctggctcttcgcttattaggcacgccgaggagatactacggaatagaggggcagatctgctttggtgtaatgcacgcacgacagcctccggttactataaaaggcttggttttagtgagcacggcgaagttttcgaaaccccgccggttgggccgcacattcttatgtacaaaagaatcacttaa

SEQ ID NO: 527 - DNA, 441 bp, Artificial Sequence
  Synthetic nucleic acid sequence
  D_S00218594_B-4G11
atgatagaagtgaaacctattaacgcagaggagacttacgaacttcgacacaagatcctgcgccctaatcagccgatagaggtatgcatgtatgaaagcgatctgctgcagggctcgttccatttgggcgggttctatcgtggccaattgatctcgattgcgagtttccacaaagctgaacactcagaactgcaagggcaaaagcagtatcaattacgagggatggcgaccctcgaaggattccgtgagcagaaggctggctcttcgcttattaggcacgccgaggagatactacggaatagaggggcagatctgctttggtgtaatgcacgcacgacagcctccggttactataaaaggcttggttttagtgagcacggcgaagttttcgaaaccccgccggttgggccgcacattcttatgtacaaaaaactcacttaa

SEQ ID NO: 528 - DNA, 441 bp, Artificial Sequence
  Synthetic nucleic acid sequence
  D_S00267527_B-8G6
atgatagaagtgaaacctattaacgcagaggagacttacgaacttcgacacaagatcctgcgccctaatcagccgatagaggcatgcatgtatgaaagcgatctgctgcgggacgcgttccatttgggcgggttctatcgtggccaattgatctcgattgcgagtttccacaaagctgaacactcagaactgcaagggcaaaagcagtatcaattacgagggatggcgaccctcgaaggattccgtgagcagaaggctggctcttcgcttattaggcacgccgaggagatactacggaataaaggggcagatctgctttggtgtaatgcacgcacgacagcctccggttactataagaggcttggttttagtgagcacggcgaagttttcgaaaccccgccggttgggccgcacattcttatgtacaaaaaactcacttaa

SEQ ID NO: 529 - DNA, 441 bp, Artificial Sequence
  Synthetic nucleic acid sequence
  D_S00220826_C3G4
atgctagaggtgaaaccgattaacgcagaggatacctatgaactaaggcataaaatactcagaccaaaccagccgatagaagcgtgtatgtatgaaaccgatttacttcgtggttcatttcacttaggcggcttttacaggggcaaactgatttccatagcttcattccaccaggccgagcactcagaactcgaaggccagaaacagtaccagctccgaggtatggctaccttggaaggttatcgtgagcagaaagcgggatcgagtctaattaaacatgctgaagaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 530 - DNA, 441 bp, Artificial Sequence
  Synthetic nucleic acid sequence
  D_S00221015_C6A1
atgctagaggtgaaaccgattaacgcagaggatacctatgaactaaggcataaaatactcagaccaaaccagccgttagaagcgtgtatgtatgaaaccgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 531 - DNA, 441 bp, Artificial Sequence
  Synthetic nucleic acid sequence
  D_S00221055_C6D5
atgctagaggtgaaaccgattaacgcagaggatacctatgaactaaggcataaaatactcagaccaaaccagccgatagaagcgtgtatgtatgaatccgatttacttcgtggttcatttcacttaggcggcttttacaggggcaaactgatttccatagcttcattccaccaggccgagcattcagaactccaaggccagaaacagtaccagctccgaggtatggctaccttggaaggttatcgtgagcagaaagcgggatcgagtctaattaaacacgctgaagaaattcttcgtaagaagggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 532 - DNA, 441 bp, Artificial Sequence
  Synthetic nucleic acid sequence
  D_S00221106_C7A8
atgctagaggtgaaaccgattaacgcagaggatacctacgaactaaggcataaaatactcagaccaaaccagccgatagaagcgtgtatgtatgaatctgatttacttcgtggttcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 533 - DNA, 441 bp, Artificial Sequence
  Synthetic nucleic acid sequence
  D_S00221021_C7B11
atgctagaggtgaaaccgattaacgcagaggatacctatgaactaaggcataaaatactcagaccaaaccagccgatagaagcgtgtatgtatgaatccgatttactttgtggttcatttcacttaggcggcttttacaggggcaaactgatttccatagcttcattccaccaggccgagcactcagaactcgaaggccagaaacagtaccagctccgaggtatggctaccttggaaggttatcgtgagcagaaagcgggatcgagtctaattaaacatgctgaagaaattcttcgtaagaagggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 534 - DNA, 441 bp, Artificial Sequence
  Synthetic nucleic acid sequence
  D_S00221095_C8B1
atgctagaggtgaaaccgattaacgcagaggatacctatgaactaaggcataaaatactcagaccaaaccagccgttagaagcgtgtatgtatgaatctgatttacttcgtggttcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaagggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 535 - DNA, 441 bp, Artificial Sequence
  Synthetic nucleic acid sequence
  D_S00221246_C8G4
atgctagaggtgaaaccgattaacgcagaggatacctatgaactaaggcataaaatactcagaccaaaccagccgatagaagcgtgtatgtatgaatccgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 536 - DNA, 441 bp, Artificial Sequence
  Synthetic nucleic acid sequence
  D_S00221401_C10F3
atgctagaggtgaaaccgattaacgcagaggatacctatgaactaaggcatgaaatactcagaccaaaccagccgatagaagcgtgtatgtatgaatctgatttacttcgtggttcatttcacttaggcggcttttacaggggcaaactgatttccatagcttcattccaccaggccgagcactcagaactcgaaggccagaaacagtaccagctccgaggtatggctaccttggaaggttatcgtgagcagaaagcgggatcgggtctaattaaacacgctgaagaaattcttcgtaagaggggggcggacttgctttggtgcaatgcgcggacatccgcctcaggctactacaaaaagttaggcttcagcgagcagggagaggtatttgatacgccgccagtaggacctcacatcctgatgtataaaaggatcacataa

SEQ ID NO: 537 - DNA, 441 bp, Artificial Sequence
  Synthetic nucleic acid sequence
  D_S00224699_17-9C8
atgatagaggtgaaaccgattaacgcagaggatacctatgaactaaggcatagaatactcagaccaaaccagccgatagaagcgtgtatgtatgaaagcgatttacttcgtggtgcatttcacttaggcggcttttacgggggcaaactgatttccatagcttcattccaccaggccgagcactcagaactccaaggccagaaacagtaccagctccgaggtatggctaccttggaaggttatcgtgagcagaaagcgggatcgagtctagttaaacacgctgaagaaattcttcgtaagaggggggcggacttgctttggtgcaatgcgcggacatccgcctcaggctactacaaaaagttaggcttcagcgagcagggagagatatttgaaacgccgccggtaggacctcacatcctgatgtataaaaggatcacataa

SEQ ID NO: 538 - DNA, 441 bp, Artificial Sequence
  Synthetic nucleic acid sequence
  D_S00224736_17-9G9
atgatagaggtgaaaccgattaacgcagaggatacctatgaactaaggcatagaatactcagaccaaaccagccgatagaagcgtgtatgtatgaaagcgatttacttcgtggtgcatttcacttaggcggctattacaggggcaaactgatttccatagcgtcattccaccaggccgagcactcagacctccaaggccagaaacagtaccagctccgaggtatggctaccttggaaggttatcgtgagcagaaagcgggatcgagtctaattaaacacgctgaagaaattcttcgtaagaggggggcggacatgctttggtgcaatgcgcggacatccgcctcaggctactacaaaaagttaggcttcagcgagcagggagaggtatttgacacgccgccggtaggacctcacatcctgatgtataaaaggctcacataa

SEQ ID NO: 539 - DNA, 441 bp, Artificial Sequence
  Synthetic nucleic acid sequence
  D_S00224759_17-10A8
atgatagaggtgaaaccgattaacgcagaggatacctatgaactaaggcataaaatactcagaccaaaccagccgatagaagcgtgtatgtatgaaagcgatttacttcgtggtgcatttcacttaggcggctattacaggggcaaactgatttccatagcttcattccaccaggccgagcactcagaactccaaggccagaaacagtaccagctccggggtatggctaccttggaaggttatcgtgagcagaaagcgggatcgagtctagttaaacacgctgaagaaattcttcgtaagaggggggcggacttgctttggtgcaatgcgcggacgtccgcctcaggctactacaaaaagttaggcttcagcgagcagggagagatatttgaaacgccgccagtaggacctcacatcctgatgtataaaaggctcacataa

SEQ ID NO: 540 - DNA, 441 bp, Artificial Sequence
  Synthetic nucleic acid sequence
  D_S00224766_17-10B3
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcttcattccaccaggctgagcactcagaactccaaggccagaaacagtaccagctccgaggtgtggctaccttggaaggttatcgtgagcagaaagcgggatcgagtctaattaaacacgctgaagaaattcttcgtaagaggggggcggacatgctttggtgtaatgcgcggacatccgcctcaggctactacaaaaagttaggcttcagcgagcagggagaggtatttgatacgccgccagtaggacctcacatcctgatgtataaaaggatcacataa

SEQ ID NO: 541 - DNA, 441 bp, Artificial Sequence
  Synthetic nucleic acid sequence
  D_S00224783_17-10C8
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcttcattccaccaggccgagcactcagaactccaaggccagaaacagtaccagctccgaggtatggctaccttggagggttatcgtgagcagaaagcgggatcgagtctaattaaacacgctgaagaaattcttcgtaagaggggggcggacttgctttggtgtaatgcgcggacatccgcctcaggctactacaaaaagttaggcttcggcgagcagggagagatatttgatacgccgccagtaggacctcacatcctgatgtataaaaggctcacataa

SEQ ID NO: 542 - DNA, 441 bp, Artificial Sequence
  Synthetic nucleic acid sequence
  D_S00260479_17-12A10
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcgtcattccaccaggccgagcactcagaactccaaggccagaaacagtaccagctccgaggtatggctaccttggaaggttatcgtgatcagaaagcgggatcgagtctaattagacacgctgaacaaattcttcgtaagaggggggcggacatgctttggtgcaatgcgcggacatccgcctcaggctactacaaaaagttaggcttcagcgagcagggagaggtatttgaaacgccgccagtaggacctcacatcctgatgtataaaaggctcacataa

SEQ ID NO: 543 - DNA, 441 bp, Artificial Sequence
  Synthetic nucleic acid sequence
  D_S00260491_17-12B10
atgatagaggtgaaaccgattaacgcagaggatacctatgaactaaggcatagaatactcagaccaaaccagccgatagaagcgtgtatgtttgaaagcgatttacttcgtggtgcgtttcacttaggcggctattacgggggcaaactgatttccatagcttcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacgtccgcctcaggctactacaaaaagctaggcttcagcgagcagggagagatatttgaaacgccgccagtaggacctcacatcctgatgtataaaaggatcacataa

SEQ ID NO: 544 - DNA, 441 bp, Artificial Sequence
  Synthetic nucleic acid sequence
  D_S00260546_17-12H5
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcttcattccaccaggccgagcactcagaactccaaggccagaaacagtaccagctccgaggtatggctaccttggagggttatcgtgagcagaaagcgggatcgagtctaattagacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 545 - DNA, 441 bp, Artificial Sequence
  Synthetic nucleic acid sequence
  D_S00260588_17-13C11
atgctagaagtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccgggccgagcactcagaactccaaggccagaaacagtaccagctccgaggtatggctaccttggaaggttatcgtgagcagaaagcgggatcgagtctagttaaacacgctgaagaaattcttcgtaagaggggggcggacttgctttggtgtaatgcgcggacatccgcctcaggctactacaaaaagttaggcttcagcgagcagggagagatatttgacacgccgccagtaggacctcacatcctgatgtataaaaggatcacataa

SEQ ID NO: 546 - DNA, 441 bp, Artificial Sequence
  Synthetic nucleic acid sequence
  D_S00260694_17-14F9
atgatagaagtgaaaccgattaacgcagaggatacctatgaactaaggcataaaatactcagaccaaaccagccgatagaagcgtgtatgtttgaaagcgatttacttcgtggtgcatttcacttaggcggctattacgggggcaaactgatttccatagcttcattccaccaggccgagcactcggaactccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggctcacataa

SEQ ID NO: 547 - DNA, 441 bp, Artificial Sequence
  Synthetic nucleic acid sequence
  D_S00260743_17-15B10
atgatagaagtgaaaccgattaacgcagaggatacctatgaactaaggcataaaatactcagaccaaaccagccgatagaagcgtgtatgtttgaaagcgatttacttcgtggtgcatttcacttaggcggcttttacgggggcaaactgatttccatagcttcattccaccaggccgagcacttagacctcgaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagagatatttgaaacgccgccagtaggacctcacatcctgatgtataaaaggctcacataa

SEQ ID NO: 548 - DNA, 441 bp, Artificial Sequence
  Synthetic nucleic acid sequence
  D_S00260793_17-15G12
atgatagaagtgaaaccgattaacgcagaggatacctatgaactaaggcatagaatactcagaccaaaccagccgatagaagcgtgtatgtttgaaagcgatttacttcgtggtgcatttcacttgggcggctattacaggggcaaactgatttccgtagcgtcattccaccaggccgagcactcagaactccaaggccagaaacagtaccagctccgaggtatggctaccttggaaggttatcgtgatcagaaagcgggatcgagtctagttaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggctcacataa

SEQ ID NO: 549 - DNA, 441 bp, Artificial Sequence
  Synthetic nucleic acid sequence
  D_S00260796_17-15H3
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcagaactccaaggccagaaacagtaccagctccgaggtatggctaccttggaaggttatcgtgagcagaaggcgggatcgagtctaattaaacacgctgaagaaattcttcgtaagaggggggcggacttgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 550 - DNA, 441 bp, Artificial Sequence
  Synthetic nucleic acid sequence
  17-16A10
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcgtcattccaccaggccgagcactcagaactccaaggccagaaacagtaccagctccgaggtatggctaccttggaaggttatcgtgagcagaaagcgggatcgagtctagttaaacacgctgaagaaattcttcgtaagaggggggcggacatgctttggtgtaatgcgcggacatccgcctcaggctactacaaaaagttaggcttcagcgagcagggagagatatttgatacgccgccagtaggacctcacatcctgatgtataaaaggatcacatga

SEQ ID NO: 551 - DNA, 441 bp, Artificial Sequence; identical to SEQ ID NO: 548
  Synthetic nucleic acid sequence
  D_S00260847_17-16D6

SEQ ID NO: 552 - DNA, 441 bp, Artificial Sequence
  Synthetic nucleic acid sequence
  D_S00260855_17-16F2
atgatagaagtgaaaccgattaacgcagaggatacctatgaactaaggcataaaatactcagaccaaaccagccgatagaagcgtgtatgtttgaaagcgatttacttcgtggtgcatttcacttgggcggcttttacaggggcaaactgatttccatagcgtcattccaccaggccgagcactcagacctcgaaggccagaaacagtaccagctccgaggtatggctaccttggaaggttatcgtgagcagaaagcgggatcgagtctaattaaacacgctgaagaaattcttcgtaagaggggggcggacatgctttggtgtaatgcgcggacatccgcctcaggctactacaaaaagttaggcttcagcgagcagggggagatatttgaaacgccgccagtaggacctcacatcctgatgtataaaaggatcacataa

SEQ ID NO: 553 - DNA, 441 bp, Artificial Sequence
  Synthetic nucleic acid sequence
  D_S00260862_17-16F9
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcttcattccaccaggccgagcactcagaactccaaggccaggaacagtaccagctccgaggtatggctaccttggaaggttatcgtgatcagaaagcgggatcgagtctagttaaacacgctgaagaaattcttcgtaagaggggggcggacttgctttggtgcaatgcgcggacatccgcctcaggctactacaaaaagttaggcttcagcgagcagggagaggtatttgaaacgccgccagtaggacctcacatcctgatgtataaaaggatcacataa

SEQ ID NO: 554 - DNA, 441 bp, Artificial Sequence
  Synthetic nucleic acid sequence
  D_S00260904_17-17B3
atgatagaagtgaaaccgattaacgcagaggatacctatgaactaaggcataaaatactcagaccaaaccagccgatagaagcgtgtatgtttgaaagcgatttacttcgtggtgcacttcacttaggcggctattacaggggcaaactgatttccatagcttcattccaccaggccgagcactcagacctccaaggccagaaacagtaccagctccgaggtatggctaccttggaaggttatcgtgagcagaaagcgggatcgagtctggttaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 555 - DNA, 441 bp, Artificial Sequence
  Synthetic nucleic acid sequence
  D_S00260929_17-17D4
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcgtcattccaccaggccgagcactcagaactccaaggccagaaacagtaccagctccgaggtatggctaccttggaaggttatcgtgagcagaaagcgggatcgagtctagttaaacacgctgaagaaattctccgtaagaggggggcggacttgctttggtgtaatgcgcggacgtccgcctcaggctactacaaaaagttaggcttcagcgagcagggagaggtatttgatacgccgccagtaggacctcacatcctgatgtataaaaggatcacataa

SEQ ID NO: 556 - DNA, 441 bp, Artificial Sequence
  Synthetic nucleic acid sequence
  D_S00260940_17-17F3
atgatagaagtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcttcattccaccaggccgagcgctcagacctccaaggccagaaacagtaccagctccgaggtatggctaccttggagggttatcgtgatcagaaagcgggatcgagtctaattagacacgctgaagaaattcttcgtaagaggggggcggacttgctttggtgtaatgcgcggacgtccgcctcaggctactacaaaaagttaggcttcagcgagcagggagagatatttgaaacgccgccagtaggacctcacatcctgatgtataaaaggatcacataa

SEQ ID NO: 557 - DNA, 441 bp, Artificial Sequence
  Synthetic nucleic acid sequence
  D_S00260942_17-17F5
atgatagaggtgaaaccgattaacgcagaggatacctatgaactaaggcatagaatactcagaccaaaccagccgatagaagcgtgtatgtttgaaagcgatttacttcgtggtgcacttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctagttaaacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 558 - DNA, 441 bp, Artificial Sequence
  Synthetic nucleic acid sequence
  D_S00260945_17-17F8
atgatagaagtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcttcattccatcaggccgagcactcagaactccaaggccagaaacagtaccagctccgaggtatggctaccttggaaggttatcgtgagcagaaagcgggatcgagtctagttaaacacgctgaagaaattcttcgtaagaggggggcggacatgctttggtgtaatgcgcggacgtccgcctcaggctactacaaaaagttaggcttcagcgagcagggagaggtatttgacacgccgccagtaggacctcacatcctgatgtataaaaggatcacataa

SEQ ID NO: 559 - DNA, 441 bp, Artificial Sequence
  Synthetic nucleic acid sequence
  D_S00224368_18-8A7
atgatagaagtgaaaccgattaacgcagaggatacctatgaactaaggcatagaatactcagaccaaaccagccgatagaagcgtgtatgtttgaaagcgatttacttcgtggtgcacttcacttaggcggcttttacgggggcaaactgatttccatagcttcattccaccaggccgagcactcagacctccaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagaggtatttgatacgccgccagtaggacctcacatcctgatgtataaaaggatcacataa

SEQ ID NO: 560 - DNA, 441 bp, Artificial Sequence
  Synthetic nucleic acid sequence
  D_S00224350_18-8B7
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactgatttccatagcgtcattccaccaggccgagcactcagacctccaaggccagaaacagtaccagctccgaggtatggctaccttggaaggttatcgtgagcagaaagcgggatcgagtctaattagacacgctgaagaaattcttcgtaagaggggggcggacatgctttggtgcaacgcgcggacatccgcctcaggctactacaaaaagttaggcttcagcgagcagggagagatatttgatacgccgccagtaggacctcacatcctgatgtataaaaggatcacataa

SEQ ID NO: 561 - DNA, 441 bp, Artificial Sequence
  Synthetic nucleic acid sequence
  D_S00224416_18-9A1
atgatagaagtgaaaccgattaacgcagaggatacctatgaactaaggcatagaatactcagaccaaaccagccgatagaagcgtgtatgtttgaaagcgatttacttcgtggtgcacttcacttaggcggctattacaggggcaaactgatttccatagcttcattccaccaggccgagcactcagacctcgaaggccggaaacagtaccagctccgaggtatggctaccttggaaggttatcgtgagcagaaagcgggatcgagtctaattaaacacgctgaagaaattcttcgtaagaggggggcggacttgctttggtgtaatgcgcggacatccgcctcaggctactacaaaaagttaggcttcagcgagcagggagaggtatttgacacgccgccagtaggacctcacatcctgatgtataaaaggatcacataa

SEQ ID NO: 562 - DNA, 441 bp, Artificial Sequence
  Synthetic nucleic acid sequence
  D_S00224422_18-9A7
atgatagaagtgaaaccgattaacgcagaggatacctatgaactaaggcatagaatactcagaccaaaccagccgatagaagcgtgtatgtatgaaagcgatttacttcgtggtgcatttcacttaggcggctattacagaggcaaactgatttccatagcttcattccaccaggccgagcactcggaactccaaggccagaaacagtaccagctccgaggtatggctaccttggaaggttatcgtgagcagaaagcgggatcgagtctaattaaacacgctgaagaaattcttcgtaagaggggggcggacatgctttggtgtaatgcgcggacatccgcctcaggctactacaaaaagttaggcttcagcgagcagggagaggtatttgatacgccgccagtaggacctcacatcctgatgtataaaaggatcacataa

SEQ ID NO: 563 - DNA, 441 bp, Artificial Sequence
  Synthetic nucleic acid sequence
  D_S00224466_18-9F3
atgatagaggtgaaaccgattaacgcagaggatacctatgaactaaggcatagaatactcagaccaaaccagccgatagaagcgtgtatgtatgaaagcgatttacttcgtggtgcatttcacttaggcggcttttacaggggcaaactgatttccatagcttcattccaccaggccgagcactcagaactccaaggccagaaacagtaccagctccgaggtatggctaccttggaaggttatcgtgagcagaaagcgggatcgagtctagttaaacacgctgaagaaattcttcgtaagaggggggcggacatgctttggtgtaatgcgcggacatccgcctcaggctactacaaaaagttaggtttcagcgagcagggagaggtatttgacacgccgccagtaggacctcacatcctgatgtataaaaggatcacataa

SEQ ID NO: 564 - DNA, 441 bp, Artificial Sequence
  Synthetic nucleic acid sequence
  D_S00261096_18-24D3
atgatagaggtgaaaccgattaacgcagaggatacctatgaactaaggcataaaatactcagaccaaaccagccgatggaagcgtgtatgtatgaaagcgatttacttcgtggtgcatttcacttaggcggcttttacaggggcaaactgatttccatagcttcattccaccaggccgagcactcagacctcgaaggccagaaacagtaccagctccgaggtatggctaccttggaaggttatcgtgagcagaaagcgggatcgagtctaattaaacacgctgaagaaattcttcgtaagaggggggcggacttgctttggtgtaatgcgcggacgtccgcctcaggctactacaaaaagttaggcttcagcgagcagggagagatatttgatacgccgccagtaggacctcacatcctgatgtataaaaggatcacataa

SEQ ID NO: 565 - DNA, 441 bp, Artificial Sequence
  Synthetic nucleic acid sequence
  D_S00261192_18-25F3
atgatagaagtgaaaccgattaacgcagaggatacctatgaactaaggcataaaatactcagaccaaaccagccgatagaagcgtgtatgtttgaaagcgatttacttcgtggtgcatttcacttaggcggctattacgggggcaaactgatttccatagcgtcattccaccaggccgagcactcggaactccaaggccagaaacagtaccagctccgaggtatggctaccttggaaggttatcgtgagcagaaagcgggatcgagtctaattagacacgctgaagaaattctccgtaagaggggggcggacatgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 566 - DNA, 441 bp, Artificial Sequence
  Synthetic nucleic acid sequence
  D_S00261438_18-28D9
atgatagargtgaaaccgattaacgcagaggatacctatgaactaaggcatagaatactcagaccaaaccagccgatagaagcgtgtatgtttgaaagcgatttacttcgtggtgcatttcacttaggcggcttttacaggggcaaactgatttccatagcttcattccaccaggccgagcactcggaactccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgcggacatccgcctcaggctactacaaaaagttaggcttcagcgagcagggagagatatttgacacgccgccagtaggacctcacatcctgatgtataaaaggatcacataa

SEQ ID NO: 567 - DNA, 441 bp, Artificial Sequence
  Synthetic nucleic acid sequence
  D_S00261440_18-28D11
atgatagaagtgaaaccgattaacgcagaggatacctatgaactaaggcatagaatactcagaccaaaccagccgatagaagcgtgtatgtttgaaagcgatttacttcgtggtgcatttcacttaggcggcttttacaggggcaaactgatttccatagcttcattccaccaggccgagcactcagacctccaaggccagaaacagtaccagctccgaggtatggctaccttggaaggttatcgtgagcagaaagcgggatcgagtctaattagacacgctgaagaaattcttcgtaagaggggggcggacttgctttggtgtaatgcgcggacatccgcctcaggctactacaaaaagttaggcttcagcgagcagggagagatatttgaaacgccgccagtaggacctcacatcctgatgtataaaaggatcacataa

SEQ ID NO: 568 - protein, 146 aa, Artificial Sequence
  Synthetic Protein Sequence
  GY12_7G1
MIEVKPINAEDTYELRHRILRPNQPIEVCMYETDLLRGAFHLGGFYRGKLISIASFHQAEHSDLEGQKQYQLRGMATLEGYREQKAGSTLIQHAEQILRKRGADMLWCNARTTAAGYYKKLGFSEQGEVFDTPPVGPHILMYKRLT

SEQ ID NO: 569 - protein, 146 aa, Artificial Sequence
  Synthetic Protein Sequence
  GY12_5A11
MIEVKPINAEDTYELRHRILRPNQPIEVCMYESDLLRGAFHLGGFYRGKLISIASFHQAEHSELQGQKQYQLRGMATLEGYRDQKAGSSLIRHAEQILRKRGADMLWCNARTSASGYYKKLGFSEQGEVFDTPPVGPHILMYKRIT

SEQ ID NO: 570 - protein, 146 aa, Artificial Sequence
  Synthetic Protein Sequence
  GY12_4H12
MIEVKPINAEETYELRHRILRPHQPIEVCMYETDLLRGAFHLGGFYRGKLISIASFHQAEHPELQGQKQYQLRGMATLEGYRDQKAGSSLIKHAEQILRKRGADMLWCNARTSAAGYYKKLGFSEQGEVFETPPVGPHIVMYKRLT

SEQ ID NO: 571 - protein, 146 aa, Artificial Sequence
  Synthetic Protein Sequence
  D_S00218358_B-2A3
MIEVKPINAEETYELRHKILRPNQPIEVCMYESDLLRGSFHLGGFYRGQLISIASFHKAEHPELQGQKQYQLRGMATLEGFREQKAGSSLIRHAEEILRNKGADLLWCNARTTASGYYKRLGFCEHGEVFETPPVGPHILMYKKLT

SEQ ID NO: 572 - protein, 146 aa, Artificial Sequence
  Synthetic Protein Sequence
  D_S00218372_B-2B5
MIEVKPINAEETYELRHKILRPNQPIEVCMYESDLLRGSFHLGGFYRGQLISIASFHKAEHPELQGQKQYQLRGMATLEGFREQKAGSSLIRHAEEILRNKGADLLWCNARTTASGYYKRLGFSEHGEVFETPPVGPHILMYKRIT

SEQ ID NO: 573 - protein, 146 aa, Artificial Sequence
  Synthetic Protein Sequence
  D_S00218373_B-2B6
MIEVKPINAEETYELRHKILRPNQPIEACMYESDLLRGSFHLGGFYRGQLISIASFHKAEHSELQGQKQYQLRGMATLEGFREQKAGSSLIRHAEEILRNKGADLLWCNARTTASGYYKRLGFSEHGEVFETPPVGPHILMYKKLT

SEQ ID NO: 574 - protein, 146 aa, Artificial Sequence
  Synthetic Protein Sequence
  D_S00267061_B-3B8
MIEVKPINAEETYELRHKILRPNQPIEVCMYESDLLRGSFHLGGFYRGQLISIASFHKAEHSELQGQKQYQLRGMATLEGFREQKAGSSLIRHAEEILRNKGADLLWCNARTTASGYYKRLGFSEHGEVFETPPVGPHILMYKRIT

SEQ ID NO: 575 - protein, 146 aa, Artificial Sequence
  Synthetic Protein Sequence
  D_S00218516_B-3H5
MIEVKPINAEETYELRHKILRPNQPIEACMYESDLLRGSFHLGGFYRGQLISIASFNKAEHSELQGQKQYQLRGMATLEGFREQKAGSSLIRHAEEILRNKGADLLWCNARTTASGYYKRLGFSEHGEVFETPPVGPHILMYKRIT

SEQ ID NO: 576 - protein, 146 aa, Artificial Sequence
  Synthetic Protein Sequence
  D_S00218540_B-4B5
MIEVKPINAEETYELRHKILRPNQPIEVCMYETDLLRGSFHLGGFYRGQLISIASFHKAEHSELQGQKQYQLRGMATLEGFREQKAGSSLIRHAEEILRNKGADLLWCNARTTASGYYKRLGFSEHGEVFETPPVGPHILMYKKLT

SEQ ID NO: 577 - protein, 146 aa, Artificial Sequence
  Synthetic Protein Sequence
  D_S00218549_B-4C2
MIEVKPINAEETYELRHKILRPNQPIEVCMYESDLLRGAFHLGGFYRGQLISIASFHKAEHPELQGQKQYQLRGMATLEGFREQKAGSSLIRHAEEILRNRGADLLWCNARTTASGYYKRLGFSEHGEVFETPPVGPHILMYKRIT

SEQ ID NO: 578 - protein, 146 aa, Artificial Sequence; identical to SEQ ID NO: 577
  Synthetic Protein Sequence
  D_S00267186_B-4G1

SEQ ID NO: 579 - protein, 146 aa, Artificial Sequence
  Synthetic Protein Sequence
  D_S00218594_B-4G11
MIEVKPINAEETYELRHKILRPNQPIEVCMYESDLLQGSFHLGGFYRGQLISIASFHKAEHSELQGQKQYQLRGMATLEGFREQKAGSSLIRHAEEILRNRGADLLWCNARTTASGYYKRLGFSEHGEVFETPPVGPHILMYKKLT

SEQ ID NO: 580 - protein, 146 aa, Artificial Sequence
  Synthetic Protein Sequence
  D_S00267527_B-8G6
MIEVKPINAEETYELRHKILRPNQPIEACMYESDLLRDAFHLGGFYRGQLISIASFHKAEHSELQGQKQYQLRGMATLEGFREQKAGSSLIRHAEEILRNKGADLLWCNARTTASGYYKRLGFSEHGEVFETPPVGPHILMYKKLT

SEQ ID NO: 581 - protein, 146 aa, Artificial Sequence
  Synthetic Protein Sequence
  D_S00220826_C3G4
MLEVKPINAEDTYELRHKILRPNQPIEACMYETDLLRGSFHLGGFYRGKLISIASFHQAEHSELEGQKQYQLRGMATLEGYREQKAGSSLIKHAEEILRKRGADLLWCNARTSASGYYKKLGFSEQGEVFDTPPVGPHILMYKRIT

SEQ ID NO: 582 - protein, 146 aa, Artificial Sequence
  Synthetic Protein Sequence
  D_S00221015_C6A1
MLEVKPINAEDTYELRHKILRPNQPLEACMYETDLLRGAFHLGGFYRGKLISIASFHQAEHSELQGQKQYQLRGMATLEGYREQKAGSSLIKHAEEILRKRGADLLWCNARTSASGYYKKLGFSEQGEVFDTPPVGPHILMYKRIT

SEQ ID NO: 583 - protein, 146 aa, Artificial Sequence
  Synthetic Protein Sequence
  D_S00221055_C6D5
MLEVKPINAEDTYELRHKILRPNQPIEACMYESDLLRGSFHLGGFYRGKLISIASFHQAEHSELQGQKQYQLRGMATLEGYREQKAGSSLIKHAEEILRKKGADLLWCNARTSASGYYKKLGFSEQGEVFDTPPVGPHILMYKRIT

SEQ ID NO: 584 - protein, 146 aa, Artificial Sequence
  Synthetic Protein Sequence
  D_S00221106_C7A8
MLEVKPINAEDTYELRHKILRPNQPIEACMYESDLLRGSFHLGGFYRGKLISIASFHQAEHSELQGQKQYQLRGMATLEGYREQKAGSSLIKHAEEILRKRGADLLWCNARTSASGYYKKLGFSEQGEVFDTPPVGPHILMYKRIT

SEQ ID NO: 585 - protein, 146 aa, Artificial Sequence
  Synthetic Protein Sequence
  D_S00221021_C7B11
MLEVKPINAEDTYELRHKILRPNQPIEACMYESDLLCGSFHLGGFYRGKLISIASFHQAEHSELEGQKQYQLRGMATLEGYREQKAGSSLIKHAEEILRKKGADLLWCNARTSASGYYKKLGFSEQGEVFDTPPVGPHILMYKRIT

SEQ ID NO: 586 - protein, 146 aa, Artificial Sequence
  Synthetic Protein Sequence
  D_S00221095_C8B1
MLEVKPINAEDTYELRHKILRPNQPLEACMYESDLLRGSFHLGGFYRGKLISIASFHQAEHSELQGQKQYQLRGMATLEGYREQKAGSSLIKHAEEILRKKGADLLWCNARTSASGYYKKLGFSEQGEVFDTPPVGPHILMYKRIT

SEQ ID NO: 587 - protein, 146 aa, Artificial Sequence
  Synthetic Protein Sequence
  D_S00221246_C8G4
MLEVKPINAEDTYELRHKILRPNQPIEACMYESDLLRGAFHLGGFYRGKLISIASFHQAEHSELQGQKQYQLRGMATLEGYREQKAGSSLIKHAEEILRKRGADLLWCNARTSASGYYKKLGFSEQGEVFDTPPVGPHILMYKRIT

SEQ ID NO: 588 - protein, 146 aa, Artificial Sequence
  Synthetic Protein Sequence
  D_S00221401_C10F3
MLEVKPINAEDTYELRHEILRPNQPIEACMYESDLLRGSFHLGGFYRGKLISIASFHQAEHSELEGQKQYQLRGMATLEGYREQKAGSGLIKHAEEILRKRGADLLWCNARTSASGYYKKLGFSEQGEVFDTPPVGPHILMYKRIT

SEQ ID NO: 589 - protein, 146 aa, Artificial Sequence
  Synthetic Protein Sequence
  D_S00224699_17-9C8
MIEVKPINAEDTYELRHRILRPNQPIEACMYESDLLRGAFHLGGFYGGKLISIASFHQAEHSELQGQKQYQLRGMATLEGYREQKAGSSLVKHAEEILRKRGADLLWCNARTSASGYYKKLGFSEQGEIFETPPVGPHILMYKRIT

SEQ ID NO: 590 - protein, 143 aa, Artificial Sequence
  Synthetic Protein Sequence
  D_S00224736_17-9G9
MIEVKPINAEDTYELRHRILRPNQPIEACMYESDLLRGAFHLGGYYRGKLISIASFHQAEHSDLQGQKQYQLRGMATLEGYREQKAGSSLIKHAEEILRKRGADMLWCNARTSASGYYKKLGFSEQGEVFDTPPVGPHILMYK

SEQ ID NO: 591 - protein, 146 aa, Artificial Sequence
  Synthetic Protein Sequence
  D_S00224759_17-10A8
MIEVKPINAEDTYELRHKILRPNQPIEACMYESDLLRGAFHLGGYYRGKLISIASFHQAEHSELQGQKQYQLRGMATLEGYREQKAGSSLVKHAEEILRKRGADLLWCNARTSASGYYKKLGFSEQGEIFETPPVGPHILMYKRLT

SEQ ID NO: 592 - protein, 146 aa, Artificial Sequence
  Synthetic Protein Sequence
  D_S00224766_17-10B3
MIEVKPINAEDTYELRHRILRPNQPIEACMFESDLLRGAFHLGGFYGGKLISIASFHQAEHSELQGQKQYQLRGVATLEGYREQKAGSSLIKHAEEILRKRGADMLWCNARTSASGYYKKLGFSEQGEVFDTPPVGPHILMYKRIT

SEQ ID NO: 593 - protein, 146 aa, Artificial Sequence
  Synthetic Protein Sequence
  D_S00224783_17-10C8
MIEVKPINAEDTYELRHRILRPNQPIEACMFESDLLRGAFHLGGFYGGKLISIASFHQAEHSELQGQKQYQLRGMATLEGYREQKAGSSLIKHAEEILRKRGADLLWCNARTSASGYYKKLGFGEQGEIFDTPPVGPHILMYKRLT

SEQ ID NO: 594 - protein, 146 aa, Artificial Sequence
  Synthetic Protein Sequence
  D_S00260479_17-12A10
MIEVKPINAEDTYELRHRILRPNQPIEACMFESDLLRGAFHLGGFYGGKLISIASFHQAEHSELQGQKQYQLRGMATLEGYRDQKAGSSLIRHAEQILRKRGADMLWCNARTSASGYYKKLGFSEQGEVFETPPVGPHILMYKRLT

SEQ ID NO: 595 - protein, 146 aa, Artificial Sequence
  Synthetic Protein Sequence
  D_S00260491_17-12B10
MIEVKPINAEDTYELRHRILRPNQPIEACMFESDLLRGAFHLGGYYGGKLISIASFHQAEHSELQGQKQYQLRGMATLEGYREQKAGSSLIKHAEEILRKRGADLLWCNARTSASGYYKKLGFSEQGEIFETPPVGPHILMYKRIT

SEQ ID NO: 596 - protein, 146 aa, Artificial Sequence
  Synthetic Protein Sequence
  D_S00260546_17-12H5
MIEVKPINAEDTYELRHRILRPNQPIEACMFESDLLRGAFHLGGFYGGKLISIASFHQAEHSELQGQKQYQLRGMATLEGYREQKAGSSLIRHAEEILRKRGADLLWCNARTSASGYYKKLGFSEQGEIFETPPVGPHILMYKRIT

SEQ ID NO: 597 - protein, 146 aa, Artificial Sequence
  Synthetic Protein Sequence
  D_S00260588_17-13C11
MLEVKPINAEDTYELRHRILRPNQPIEACMFESDLLRGAFHLGGYYGGKLISIASFHRAEHSELQGQKQYQLRGMATLEGYREQKAGSSLVKHAEEILRKRGADLLWCNARTSASGYYKKLGFSEQGEIFDTPPVGPHILMYKRIT

SEQ ID NO: 598 - protein, 146 aa, Artificial Sequence
  Synthetic Protein Sequence
  D_S00260694_17
MIEVKPINAEDTYELRHKILRPNQPIEACMFESDLLRGAFHLGGYYGGKLISIASFHQAEHSELQGQKQYQLRGMATLEGYREQKAGSSLIKHAEEILRKRGADLLWCNARTSASGYYKKLGFSEQGEIFETPPVGPHILMYKRLT

SEQ ID NO: 599 - protein, 146 aa, Artificial Sequence
  Synthetic Protein Sequence
  D_S00260743_17-15B10
MIEVKPINAEDTYELRHKILRPNQPIEACMFESDLLRGAFHLGGFYGGKLISIASFHQAEHLDLEGQKQYQLRGMATLEGYREQKAGSSLIKHAEEILRKRGADLLWCNARTSASGYYKKLGFSEQGEIFETPPVGPHILMYKRLT

SEQ ID NO: 600 - protein, 146 aa, Artificial Sequence
  Synthetic Protein Sequence
  D_S00260793_17-15G12
MIEVKPINAEDTYELRHRILRPNQPIEACMFESDLLRGAFHLGGYYRGKLISVASFHQAEHSELQGQKQYQLRGMATLEGYRDQKAGSSLVKHAEEILRKRGADLLWCNARTSASGYYKKLGFSEQGEIFETPPVGPHILMYKRLT

SEQ ID NO: 601 - protein, 146 aa, Artificial Sequence
  Synthetic Protein Sequence
  D_S00260796_17-15H3
MIEVKPINAEDTYELRHRILRPNQPIEACMFESDLLRGAFHLGGYYGGKLISIASFHQAEHSELQGQKQYQLRGMATLEGYREQKAGSSLIKHAEEILRKRGADLLWCNARTSASGYYKKLGFSEQGEVFDTPPVGPHILMYKRIT

SEQ ID NO: 602 - protein, 146 aa, Artificial Sequence
  Synthetic Protein Sequence
  17-16A10
MIEVKPINAEDTYELRHRILRPNQPIEACMFESDLLRGAFHLGGYYRGKLISIASFHQAEHSELQGQKQYQLRGMATLEGYREQKAGSSLVKHAEEILRKRGADMLWCNARTSASGYYKKLGFSEQGEIFDTPPVGPHILMYKRIT

SEQ ID NO: 603 - protein, 146 aa, Artificial Sequence; identical to SEQ ID NO: 600
  Synthetic Protein Sequence
  D_S00260847_17-16D6

SEQ ID NO: 604 - protein, 146 aa, Artificial Sequence
  Synthetic Protein Sequence
  D_S00260855_17-16F2
MIEVKPINAEDTYELRHKILRPNQPIEACMFESDLLRGAFHLGGFYRGKLISIASFHQAEHSDLEGQKQYQLRGMATLEGYREQKAGSSLIKHAEEILRKRGADMLWCNARTSASGYYKKLGFSEQGEIFETPPVGPHILMYKRIT

SEQ ID NO: 605 - protein, 146 aa, Artificial Sequence
  Synthetic Protein Sequence
  D_S00260862_17-16F9
MIEVKPINAEDTYELRHRILRPNQPIEACMFESDLLRGAFHLGGYYRGKLISIASFHQAEHSELQGQEQYQLRGMATLEGYRDQKAGSSLVKHAEEILRKRGADLLWCNARTSASGYYKKLGFSEQGEVFETPPVGPHILMYKRIT

SEQ ID NO: 606 - protein, 146 aa, Artificial Sequence
  Synthetic Protein Sequence
  D_S00260904_17-17B3
MIEVKPINAEDTYELRHKILRPNQPIEACMFESDLLRGALHLGGYYRGKLISIASFHQAEHSDLQGQKQYQLRGMATLEGYREQKAGSSLVKHAEEILRKRGADLLWCNARTSASGYYKKLGFSEQGEIFETPPVGPHILMYKRIT

SEQ ID NO: 607 - protein, 146 aa, Artificial Sequence
  Synthetic Protein Sequence
  D_S00260929_17-17D4
MIEVKPINAEDTYELRHRILRPNQPIEACMFESDLLRGAFHLGGYYRGKLISIASFHQAEHSELQGQKQYQLRGMATLEGYREQKAGSSLVKHAEEILRKRGADLLWCNARTSASGYYKKLGFSEQGEVFDTPPVGPHILMYKRIT

SEQ ID NO: 608 - protein, 146 aa, Artificial Sequence
  Synthetic Protein Sequence
  D_S00260940_17-17F3
MIEVKPINAEDTYELRHRILRPNQPIEACMFESDLLRGAFHLGGYYRGKLISIASFHQAERSDLQGQKQYQLRGMATLEGYRDQKAGSSLIRHAEEILRKRGADLLWCNARTSASGYYKKLGFSEQGEIFETPPVGPHILMYKRIT

SEQ ID NO: 609 - protein, 146 aa, Artificial Sequence
  Synthetic Protein Sequence
  D_S00260942_17-17F5
MIEVKPINAEDTYELRHRILRPNQPIEACMFESDLLRGALHLGGFYRGKLISIASFHQAEHSELQGQKQYQLRGMATLEGYREQKAGSSLVKHAEEILRKRGADLLWCNARTSASGYYKKLGFSEQGEIFETPPVGPHILMYKRIT

SEQ ID NO: 610 - protein, 146 aa, Artificial Sequence
  Synthetic Protein Sequence
  D_S00260945_17-17F8
MIEVKPINAEDTYELRHRILRPNQPIEACMFESDLLRGAFHLGGYYRGKLISIASFHQAEHSELQGQKQYQLRGMATLEGYREQKAGSSLVKHAEEILRKRGADMLWCNARTSASGYYKKLGFSEQGEVFDTPPVGPHILMYKRIT

SEQ ID NO: 611 - protein, 146 aa, Artificial Sequence
  Synthetic Protein Sequence
  D_S00224368_18-8A7
MIEVKPINAEDTYELRHRILRPNQPIEACMFESDLLRGALHLGGFYGGKLISIASFHQAEHSDLQGQKQYQLRGMATLEGYREQKAGSSLIKHAEEILRKRGADLLWCNARTSASGYYKKLGFSEQGEVFDTPPVGPHILMYKRIT

SEQ ID NO: 612 - protein, 146 aa, Artificial Sequence
  Synthetic Protein Sequence
  D_S00224350_18-8B7
MIEVKPINAEDTYELRHRILRPNQPIEACMFESDLLRGAFHLGGYYRGKLISIASFHQAEHSDLQGQKQYQLRGMATLEGYREQKAGSSLIRHAEEILRKRGADMLWCNARTSASGYYKKLGFSEQGEIFDTPPVGPHILMYKRIT

SEQ ID NO: 613 - protein, 146 aa, Artificial Sequence
  Synthetic Protein Sequence
  D_S00224416_18-9A1
MIEVKPINAEDTYELRHRILRPNQPIEACMFESDLLRGALHLGGYYRGKLISIASFHQAEHSDLEGRKQYQLRGMATLEGYREQKAGSSLIKHAEEILRKRGADLLWCNARTSASGYYKKLGFSEQGEVFDTPPVGPHILMYKRIT

SEQ ID NO: 614 - protein, 146 aa, Artificial Sequence
  Synthetic Protein Sequence
  D_S00224422_18-9A7
MIEVKPINAEDTYELRHRILRPNQPIEACMYESDLLRGAFHLGGYYRGKLISIASFHQAEHSELQGQKQYQLRGMATLEGYREQKAGSSLIKHAEEILRKRGADMLWCNARTSASGYYKKLGFSEQGEVFDTPPVGPHILMYKRIT

SEQ ID NO: 615 - protein, 146 aa, Artificial Sequence
  Synthetic Protein Sequence
  D_S00224466_18-9F3
MIEVKPINAEDTYELRHRILRPNQPIEACMYESDLLRGAFHLGGFYRGKLISIASFHQAEHSELQGQKQYQLRGMATLEGYREQKAGSSLVKHAEEILRKRGADMLWCNARTSASGYYKKLGFSEQGEVFDTPPVGPHILMYKRIT

SEQ ID NO: 616 - protein, 146 aa, Artificial Sequence
  Synthetic Protein Sequence
  D_S00261096_18-24D3
MIEVKPINAEDTYELRHKILRPNQPMEACMYESDLLRGAFHLGGFYRGKLISIASFHQAEHSDLEGQKQYQLRGMATLEGYREQKAGSSLIKHAEEILRKRGADLLWCNARTSASGYYKKLGFSEQGEIFDTPPVGPHILMYKRIT

SEQ ID NO: 617 - protein, 146 aa, Artificial Sequence
  Synthetic Protein Sequence
  D_S00261192_18-25F3
MIEVKPINAEDTYELRHKILRPNQPIEACMFESDLLRGAFHLGGYYGGKLISIASFHQAEHSELQGQKQYQLRGMATLEGYREQKAGSSLIRHAEEILRKRGADMLWCNARTSASGYYKKLGFSEQGEIFETPPVGPHILMYKRIT

SEQ ID NO: 618 - protein, 146 aa, Artificial Sequence
  Synthetic Protein Sequence
  D_S00261438_18-28D9
MIEVKPINAEDTYELRHRILRPNQPIEACMFESDLLRGAFHLGGFYRGKLISIASFHQAEHSELQGQKQYQLRGMATLEGYREQKAGSTLVKHAEEILRKRGADMLWCNARTSASGYYKKLGFSEQGEIFDTPPVGPHILMYKRIT

SEQ ID NO: 619 - protein, 146 aa, Artificial Sequence
  Synthetic Protein Sequence
  D_S00261440_18-28D11
MIEVKPINAEDTYELRHRILRPNQPIEACMFESDLLRGAFHLGGFYRGKLISIASFHQAEHSDLQGQKQYQLRGMATLEGYREQKAGSSLIRHAEEILRKRGADLLWCNARTSASGYYKKLGFSEQGEIFETPPVGPHILMYKRIT

SEQ ID NO: 620 - DNA, 441 bp, Artificial Sequence
  Synthetic nucleic acid sequence
  D_GE002256_GAT20-12F7
  CDS (1)...(441)
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagattcgaggtgtggctaccttagaaggttatcgtgagcagaaggcgggatccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 621 - protein, 146 aa, Artificial Sequence
  D_GE002256_GAT20-12F7
  Synthetic Protein Sequence
MIEVKPINAEDTYDLRHRVLRPNQPIEACMFESDLMRGAFHLGGFYGGKLISVASFHQAEHSELQGQKQYQIRGVATLEGYREQKAGSSLVKHAEEILRKRGADLLWCNARTSASGYYRKLGFSEQGEVFDTPPVGPHILMYKRIT

SEQ ID NO: 622 - DNA, 441 bp, Artificial Sequence
  Synthetic nucleic acid sequence
  D_GE003194_GAT20-12F7b
  CDS (1)...(441)
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagattcgaggtgtggctaccttagaaggttatcgtgagcagaaggcgggttccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 623 - protein, 146 aa, Artificial Sequence; identical to SEQ ID NO: 621
  Synthetic Protein Sequence
  D_GE003194_GAT20-12F7b

SEQ ID NO: 624 - DNA, 441 bp, Artificial Sequence
  Synthetic nucleic acid sequence
  CDS (1)...(441)
  D_GE002257_GAT20-13A2
atgatagaggtaaaaccgattaacgcagaggatacctatgacctaaggcatagaatcctcagaccaaaccagccgatagaagcgtgtatctttgaaagcgatttaatgcgtggtgcatttcacttaggcggctactacgggggcaaactgatttccatcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacatactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 625 - protein, 146 aa, Artificial Sequence
  D_GE002257_GAT20-13A2
  Synthetic Protein Sequence
MIEVKPINAEDTYDLRHRILRPNQPIEACIFESDLMRGAFHLGGYYGGKLISIASFHQAEHSELQGQKQYQLRGMATLEGYREQKAGTSLVKHAEEILRKRGADILWCNARTSASGYYKKLGFSEQGEVFDTPPVGPHILMYKRIT

SEQ ID NO: 626 - DNA, 441 bp, Artificial Sequence
  Synthetic nucleic acid sequence
  CDS (1)...(441)
  D_GE002258_GAT20-13H9
atgatagaggtaaaaccgattaacgcagaggatacctatgacctaaggcatagagtcctcagaccaaaccagccgatagaagcgtgtatgtttgaaagcgatttactgcgtggtgcatttcacttaggcggctactacgggggcaaactgatttccgtcgcttcattccaccaggccgagcacacggaacttcaaggccagaaacagtaccagattcgaggtgtggctaccttggaaggttatcgtgagcagaaggcgggaaccagtctagttaaacacgctgaagaaattctacgtaagaggggggcggacctactttggtgtaatgcgcggacatccgcctcaggcttctacagaaagttaggcttcagcgagcagggagagatattcgacacgccgccagtaggacctcacatcctgatgtataaatggatcacataa

SEQ ID NO: 627 - protein, 146 aa, Artificial Sequence
  D_GE002258_GAT20-13H9
  Synthetic Protein Sequence
MIEVKPINAEDTYDLRHRVLRPNQPIEACMFESDLLRGAFHLGGYYGGKLISVASFHQAEHTELQGQKQYQIRGVATLEGYREQKAGTSLVKHAEEILRKRGADLLWCNARTSASGFYRKLGFSEQGEIFDTPPVGPHILMYKWIT

SEQ ID NO: 628 - DNA, 441 bp, Artificial Sequence
  Synthetic nucleic acid sequence
  CDS (1)...(441)
  D_GE002259_GAT20-14A6
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggctactacgggggcaaactgatttccgtcgcttcattccaccaggccgagcactcggaacttccaggccagaaacagtaccagcttcgaggtgtggctaccttggaaggttatcgtgagcagaaggcgggaaccagtctagttaaacacgctgaagaaattctacgtaagaggggggcggacatactttggtgtaatgcgcggacatccgcctcaggcttctacagaaagttaggcttcagcgagcagggagaggtattcgacacgccgccagtaggacctcacatcctgatgtataaaaggatcacataa

SEQ ID NO: 629 - protein, 146 aa, Artificial Sequence
  D_GE002259_GAT20-14A6
  Synthetic Protein Sequence
MIEVKPINAEDTYDLRHRVLRPNQPIEACMFESDLMRGAFHLGGYYGGKLISVASFHQAEHSELPGQKQYQLRGVATLEGYREQKAGTSLVKHAEEILRKRGADILWCNARTSASGFYRKLGFSEQGEVFDTPPVGPHILMYKRIT

SEQ ID NO: 630 - DNA, 441 bp, Artificial Sequence
  Synthetic nucleic acid sequence
  CDS (1)...(441)
  D_GE002260_GAT20-14A11
atgatagaggtaaaaccgattaacgcagaggatacctatgacctaaggcatagagtcctcagaccaaaccagccgatagaagcgtgtatctttgaaagcgatttactgcgtggtgcatttcacttaggcggcttctacgggggcagactgatttccatcgcttcattccaccaggccgagcactcggaaattcaaggccagaaacagtaccagcttcgaggtatggctaccttggaaggttatcgtgagcagaaggcgggatccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 631 - protein, 146 aa, Artificial Sequence
  D_GE002260_GAT20-14A11
  Synthetic Protein Sequence
MIEVKPINAEDTYDLRHRVLRPNQPIEACIFESDLLRGAFHLGGFYGGRLISIASFHQAEHSEIQGQKQYQLRGMATLEGYREQKAGSSLVKHAEEILRKRGADMLWCNARTSASGYYRKLGFSEQGEVFDTPPVGPHILMYKRIT

SEQ ID NO: 632 - DNA, 441 bp, Artificial Sequence
  Synthetic nucleic acid sequence
  CDS (1)...(441)
  D_GE003195_GAT20-14A11b
atgatagaggtaaaaccgattaacgcagaggatacctatgacctaaggcatagagtcctcagaccaaaccagccgatagaagcgtgtatctttgaaagcgatttactgcgtggtgcatttcacttaggcggcttctacgggggcagactgatttccatcgcttcattccaccaggccgagcactcggaaattcaaggccagaaacagtaccagcttcgaggtatggctaccttggaaggttatcgtgagcagaaggcgggttccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 633 - protein, 146 aa, Artificial Sequence; identical to SEQ ID NO: 631
  D_GE003195_GAT20-14A11b
  Synthetic Protein Sequence

SEQ ID NO: 634 - DNA, 441 bp, Artificial Sequence
  Synthetic nucleic acid sequence
  CDS (1)...(441)
  D_GE002261_GAT20-14G7
atgatagaggtaaaaccgattaacgcagaggatacctatgacctaaggcatagagtcctcagaccaaaccagccgatagaagcgtgtatgtttgatagcgatttactgcgtggtgcatttcacttaggcggctactacgggggcagactgatttccatcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacatactttggtgtaatgcgcggacatccgcctcaggctactacaaaaagttaggcttcagcgagcagggagagatattcgacacgccgccagtaggacctcacatcctgatgtataaaaggatcacataa

SEQ ID NO: 635 - protein, 146 aa, Artificial Sequence
  D_GE002261_GAT20-14G7
  Synthetic Protein Sequence
MIEVKPINAEDTYDLRHRVLRPNQPIEACMFDSDLLRGAFHLGGYYGGRLISIASFHQAEHSELQGQKQYQLRGVATLEGYREQKAGTSLVKHAEEILRKRGADILWCNARTSASGYYKKLGFSEQGEIFDTPPVGPHILMYKRIT

SEQ ID NO: 636 - DNA, 441 bp, Artificial Sequence
  Synthetic nucleic acid sequence
  CDS (1)...(441)
  D_GE002262_GAT20-14H3
atgatagaggtaaaaccgattaacgcagaggatacctatgacctaaggcatagagtcctcagaccaaaccagccgatagaagcgtgtatgtttgaaagcgatttattgcgtggtgcatttcacttaggcggctactacgggggcagactgatttccgtcgcttcattccaccaggccgagcactcggaacttcaaggccagaaacagtaccagcttcgaggtatggctaccttggaaggttatcgtgagcagaaggcgggatccagtctagttaaacacgctgaagaaattatacgtaagaggggggcggacctactttggtgtaatgcgcggacatccgcctcaggcttctacagaaagttaggcttcagcgagcagggagaggtattcgacacgccgccagtaggacctcacatcctgatgtataaaaggatcacataa

SEQ ID NO: 637 - protein, 146 aa, Artificial Sequence
  D_GE002262_GAT20-14H3
  Synthetic Protein Sequence
MIEVKPINAEDTYDLRHRVLRPNQPIEACMFESDLLRGAFHLGGYYGGRLISVASFHQAEHSELQGQKQYQLRGMATLEGYREQKAGSSLVKHAEEIIRKRGADLLWCNARTSASGFYRKLGFSEQGEVFDTPPVGPHILMYKRIT

SEQ ID NO: 638 - DNA, 441 bp, Artificial Sequence
  Synthetic nucleic acid sequence
  CDS (1)...(441)
  D_GE002263_GAT20-16A3
atgatagaggtaaaaccgattaacgcagaggatacctatgaactaaggcatagagtcctcagaccaaaccagccgatagaagcgtgtatgtttgatagcgatttactgcgtggtgcatttcacttaggcggcttctacgggggcagactgatttccgtcgcttcattccaccaggccgagcacacggaacttcaaggccagaaacagtaccagcttcgaggtgtggctaccttggaaggttatcgtgagcagaaggcgggaaccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 639 - protein, 146 aa, Artificial Sequence
  D_GE002263_GAT20-16A3
  Synthetic Protein Sequence
MIEVKPINAEDTYELRHRVLRPNQPIEACMFDSDLLRGAFHLGGFYGGRLISVASFHQAEHTELQGQKQYQLRGVATLEGYREQKAGTSLVKHAEEILRKRGADLLWCNARTSASGYYRKLGFSEQGEVFDTPPVGPHILMYKRIT

SEQ ID NO: 640 - DNA, 441 bp, Artificial Sequence
  Synthetic nucleic acid sequence
  CDS (1)...(441)
  D_GE003196_GAT20-16A3b
atgatagaggtaaaaccgattaacgcagaggatacctatgaactaaggcatagagtcctcagaccaaaccagccgatagaagcgtgtatgtttgatagcgatttactgcgtggtgcatttcacttaggcggcttctacgggggcagactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 641 - protein, 146 aa, Artificial Sequence
  D_GE003196_GAT20-16A3b
  Synthetic Protein Sequence
MIEVKPINAEDTYELRHRVLRPNQPIEACMFDSDLLRGAFHLGGFYGGRLISVASFHQAEHSELQGQKQYQLRGVATLEGYREQKAGTSLVKHAEEILRKRGADLLWCNARTSASGYYRKLGFSEQGEVFDTPPVGPHILMYKRIT

SEQ ID NO: 642 - DNA, 441 bp, Artificial Sequence
  Synthetic nucleic acid sequence
  CDS (1)...(441)
  D_GE002264_GAT20-16C7
atgatagaggtaaaaccgattaacgcagaggatacctatgaactaaggcatagagtcctcagaccaaaccagccgatagaagcgtgtatctttgaaagcgatttaatgcgtggtgcatttcacttaggcggcttctacgggggcaaactgatttccatcgcttcattccaccaggccgagcacacggaacttcaaggccagaaacagtaccagcttcgaggtgtggctaccttggaaggttatcgtgagcagaaggcgggaaccagtctacttaaacacgctgaagaaattctacgtaagaggggggcggacctgctttggtgtaatgcgcggacatccgcctcaggcttctacaaaaagttaggcttcagcgagcagggagaggtattcgacacgccgccagtaggacctcacatcctgatgtataaaaggatcacataa

SEQ ID NO: 643 - protein, 146 aa, Artificial Sequence
  D_GE002264_GAT20-16C7
  Synthetic Protein Sequence
MIEVKPINAEDTYELRHRVLRPNQPIEACIFESDLMRGAFHLGGFYGGKLISIASFHQAEHTELQGQKQYQLRGVATLEGYREQKAGTSLLKHAEEILRKRGADLLWCNARTSASGFYKKLGFSEQGEVFDTPPVGPHILMYKRIT

SEQ ID NO: 644 - DNA, 441 bp, Artificial Sequence
  Synthetic nucleic acid sequence
  CDS (1)...(441)
  D_GE002265_GAT20-16G8
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctacttaaacacgctgaagaaattatacgtaagaggggggcggacatgctttggtgtaatgcgcggacatccgcctcaggcttctacaaaaagttaggcttcagcgagcagggagaggtattcgacacgccgccagtaggacctcacatcctgatgtataaaaggatcacataa

SEQ ID NO: 645 - protein, 146 aa, Artificial Sequence
  D_GE002265_GAT20-16G8
  Synthetic Protein Sequence
MIEVKPINAEDTYDLRHRVLRPNQPIEACMFESDLMRGAFHLGGFYGGKLISVASFHQAEHSELQGQKQYQLRGVATLEGYREQKAGTSLLKHAEEIIRKRGADMLWCNARTSASGFYKKLGFSEQGEVFDTPPVGPHILMYKRIT

SEQ ID NO: 646 - DNA, 441 bp, Artificial Sequence
  Synthetic nucleic acid sequence
  CDS (1)...(441)
  D_GE002266_GAT20-17A10
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcagactgatttccatcgcttcattccaccaggccgagcacacggaacttcaaggccagaaacagtaccagcttcgaggtgtggctaccttggaaggttatcgtgagcagaaggcgggatccagtctagttaaacacgctgaagaaattctacgtaagaggggggcggacctactttggtgtaatgcgcggacatccgcctcaggctactacagaaagttaggcttcagcgagcagggagagatattcgacacgccgccagtaggacctcacatcctgatgtataaaaggatcacataa

SEQ ID NO: 647 - protein, 146 aa, Artificial Sequence
  D_GE002266_GAT20-17A10
  Synthetic Protein Sequence
MIEVKPINAEDTYDLRHRVLRPNQPIEACMFDSDLMRGAFHLGGFYGGRLISIASFHQAEHTELQGQKQYQLRGVATLEGYREQKAGSSLVKHAEEILRKRGADLLWCNARTSASGYYRKLGFSEQGEIFDTPPVGPHILMYKRIT

SEQ ID NO: 648 - DNA, 441 bp, Artificial Sequence
  Synthetic nucleic acid sequence
  CDS (1)...(441)
  D_GE003197_GAT20-17A10b
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcagactgatttccatcgcttcattccaccaggccgagcactcggaacttcaaggccagaaacagtaccagcttcgaggtgtggctaccttggaaggttatcgtgagcagaaggcgggttccagtctagttaaacacgctgaagaaattctacgtaagaggggggcggacctactttggtgtaatgcgcggacatccgcctcaggctactacagaaagttaggcttcagcgagcagggagagatattcgacacgccgccagtaggacctcacatcctgatgtataaaaggatcacataa

SEQ ID NO: 649 - protein, 146 aa, Artificial Sequence
  D_GE003197_GAT20-17A10b
  Synthetic Protein Sequence
MIEVKPINAEDTYDLRHRVLRPNQPIEACMFDSDLMRGAFHLGGFYGGRLISIASFHQAEHSELQGQKQYQLRGVATLEGYREQKAGSSLVKHAEEILRKRGADLLWCNARTSASGYYRKLGFSEQGEIFDTPPVGPHILMYKRIT

SEQ ID NO: 650 - DNA, 441 bp, Artificial Sequence
  Synthetic nucleic acid sequence
  CDS (1)...(441)
  D_GE002267_GAT20-17B11
atgatagagataaaaccgattaacgcagaggatacctatgaactaaggcatagagtcctcagaccaaaccagccgatagaagcgtgtatctttgatagcgatttaatgcgtggtgcatttcacttaggcggctactacgggggcaaactgatttccatcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacatactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 651 - protein, 146 aa, Artificial Sequence
  D_GE002267_GAT20-17B11
  Synthetic Protein Sequence
MIEIKPINAEDTYELRHRVLRPNQPIEACIFDSDLMRGAFHLGGYYGGKLISIASFHQAEHSELQGQKQYQLRGMATLEGYREQKAGTSLVKHAEEILRKRGADILWCNARTSASGYYRKLGFSEQGEVFDTPPVGPHILMYKRIT

SEQ ID NO: 652 - DNA, 441 bp, Artificial Sequence; identical to SEQ ID NO: 646
  Synthetic nucleic acid sequence
  CDS (1)...(441)
  D_GE002268_GAT20-17C1

SEQ ID NO: 653 - protein, 146 aa, Artificial Sequence; identical to SEQ ID NO: 647
  D_GE002268_GAT20-17C1
  Synthetic Protein Sequence

SEQ ID NO: 654 - DNA, 441 bp, Artificial Sequence
  Synthetic nucleic acid sequence
  CDS (1)...(441)
  D_GE002269_GAT20-18D7
atgatagaggtaaaaccgattaacgcagaggatacctatgacctaaggcatagagtcctcagaccaaaccagccgatagaagcgtgtatgtttgatagcgatttactgcgtggtgcatttcacttaggcggctactacgggggcagactgatttccgtcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacatactttggtgtaatgcgcggacatccgcctcaggctactacagaaagttaggcttcagcgagcagggagatgtattcgacacgccgccagtaggacctcacatcctgatgtataaaaggatcacataa

SEQ ID NO: 655 - protein, 146 aa, Artificial Sequence
  D_GE002269_GAT20-18D7
  Synthetic Protein Sequence
MIEVKPINAEDTYDLRHRVLRPNQPIEACMFDSDLLRGAFHLGGYYGGRLISVASFHQAEHSELQGQKQYQLRGMATLEGYREQKAGTSLVKHAEEILRKRGADILWCNARTSASGYYRKLGFSEQGDVFDTPPVGPHILMYKRIT

SEQ ID NO: 656 - DNA, 441 bp, Artificial Sequence
  Synthetic nucleic acid sequence
  CDS (1)...(441)
  D_GE002270_GAT20-18D9
atgatagaggtaaaaccgattaacgcagaggatacctatgacctaaggcatagagtcctcagaccaaaccagccgatagaagcgtgtatctttgaaagcgatttaatgcgtggtgcatttcacttaggcggcttctacgggggcagactgatttccatcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggtggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 657 - protein, 146 aa, Artificial Sequence
  D_GE002270_GAT20-18D9
  Synthetic Protein Sequence
MIEVKPINAEDTYDLRHRVLRPNQPIEACIFESDLMRGAFHLGGFYGGRLISIASFHQAEHSELQGQKQYQLRGVATLEGYREQKAGTSLVKHAEEILRKRGVDLLWCNARTSASGYYRKLGFSEQGEVFDTPPVGPHILMYKRIT

SEQ ID NO: 658 - DNA, 441 bp, Artificial Sequence; identical to SEQ ID NO: 638
  Synthetic nucleic acid sequence
  CDS (1)...(441)
  D_GE002271_GAT20-20H10

SEQ ID NO: 659 - protein, 146 aa, Artificial Sequence; identical to SEQ ID NO: 639
  D_GE002271_GAT20-20H10
  Synthetic Protein Sequence

SEQ ID NO: 660 - DNA, 441 bp, Artificial Sequence
  Synthetic nucleic acid sequence
  CDS (1)...(441)
  D_GE002272_GAT20-22G5
atgatagaggtaaaaccgattaacgcagaggatacctatgaactaaggcatagagtcctcagaccaaaccagccgatagaagcgtgtatctttgaaagcgatttaatgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggatccagtctagttaaacacgctgaagaaattctacgtaagaggggggcggacctactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 661 - protein, 146 aa, Artificial Sequence
  D_GE002272_GAT20-22G5
  Synthetic Protein Sequence
MIEVKPINAEDTYELRHRVLRPNQPIEACIFESDLMRGAFHLGGFYGGRLISVASFHQAEHSELQGQKQYQLRGMATLEGYREQKAGSSLVKHAEEILRKRGADLLWCNARTSASGYYKKLGFSEQGEVFDTPPVGPHILMYKRIT

SEQ ID NO: 662 - DNA, 441 bp, Artificial Sequence; identical to SEQ ID NO: 654
  Synthetic nucleic acid sequence
  CDS (1)...(441)
  D_GE002273_GAT20-22H1

SEQ ID NO: 663 - protein, 146 aa, Artificial Sequence; identical to SEQ ID NO: 655
  D_GE002273_GAT20-22H1
  Synthetic Protein Sequence

SEQ ID NO: 664 - DNA, 441 bp, Artificial Sequence
  Synthetic nucleic acid sequence
  CDS (1)...(441)
  D_GE002274_GAT19-11C8
atgatagaagtgaaaccgattaacgcagaggatacctatgaactaaggcatagaatactcagaccaaaccagccggtagaagcgtgtatgtttgaaagcgatttacttcgtggtgcatttcacttaggcggctattacgggggcaaactggtttccatagcttcattccaccaggccgagcactcggaactccaaggccagaaacagtaccagctccgaggtatggctaccttggaaggtcaccgtgagcagaaagcgggatcgagtctaattaaacacgctgaagaaatccttcgtaagaggggggcggacatgctttggtgcaatgcgcggacatccgcctcaggctactacaaaaagttaggcttcagcgagcagggagaggtattcgacacgccgccagtaggacctcacatcctgatgtataaaaggatcacataa

SEQ ID NO: 665 - protein, 146 aa, Artificial Sequence
  D_GE002274_GAT19-11C8
  Synthetic Protein Sequence
MIEVKPINAEDTYELRHRILRPNQPVEACMFESDLLRGAFHLGGYYGGKLVSIASFHQAEHSELQGQKQYQLRGMATLEGHREQKAGSSLIKHAEEILRKRGADMLWCNARTSASGYYKKLGFSEQGEVFDTPPVGPHILMYKRIT

SEQ ID NO: 666 - DNA, 441 bp, Artificial Sequence
  Synthetic nucleic acid sequence
  CDS (1)...(441)
  D_GE002275_GAT19-11D6
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcagaactccaaggccaggaacagtaccagctccgaggtatggctaccttggaaggttatcgtgagcagaaagcgggatcaactctagttaaacacgctgaagaaattcttcgtaagaggggggcggacatgctttggtgtaatgcgcggacatccgcctcaggctactacaaaaagttaggcttcagcgagcagggagagatatttgacacgccgccagtaggacctcacatcctgatgtataaaaggatcacataa

SEQ ID NO: 667 - protein, 146 aa, Artificial Sequence
  D_GE002275_GAT19-11D6
  Synthetic Protein Sequence
MIEVKPINAEDTYELRHRILRPNQPIEACMFESDLLRGAFHLGGYYGGKLISIASFHQAEHSELQGQEQYQLRGMATLEGYREQKAGSTLVKHAEEILRKRGADMLWCNARTSASGYYKKLGFSEQGEIFDTPPVGPHILMYKRIT

SEQ ID NO: 668 - DNA, 441 bp, Artificial Sequence
  Synthetic nucleic acid sequence
  CDS (1)...(441)
  D_GE002276_GAT19-11D8
atgatagaggtgaaaccgattaacgcagaggatacctatgagctaaggcatagaatactcagaccaaaccagccgatagaagcgtgtatgtttgaaagcgatttacttcgtggtgcatttcacttaggcggcttttacgggggcaaactgatttctatagcttcattccaccaggccgagcactcagacctccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgcggacatccgcctcaggctactacaaaaagttaggcttcagcgagcagggagaggtatttgaaacgccgccagtaggacctcacatcctgatgtataaaaggctcacataa

SEQ ID NO: 669 - protein, 146 aa, Artificial Sequence
  D_GE002276_GAT19-11D8
  Synthetic Protein Sequence
MIEVKPINAEDTYELRHRILRPNQPIEACMFESDLLRGAFHLGGFYGGKLISIASFHQAEHSDLQGQKQYQLRGMATLEGYREQKAGSTLVKHAEEILRKRGADMLWCNARTSASGYYKKLGFSEQGEVFETPPVGPHILMYKRLT

SEQ ID NO: 670 - DNA, 441 bp, Artificial Sequence
  Synthetic nucleic acid sequence
  CDS (1)...(441)
  D_GE002277_GAT19-11H12
atgatagaagtgaaaccgattaacgcagaggatacctatgaactaaggcataaaatactcagaccaaaccagccgttagaagtgtgtatgtatgaaagcgatttacttcgtggtgcatttcacttaggcggctattacgggggcaaactgatttccatagcttcattccaccaggctgagcacccagaactccaaggccagaaacagtaccagctccgaggtgtggctaccttggaaggttatcgtgatcagaaagcgggatcgagtctaattagacacgctgaagaaattcttcgtaagaggggggcggacatgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 671 - protein, 146 aa, Artificial Sequence
  D_GE002277_GAT19-11H12
  Synthetic Protein Sequence
MIEVKPINAEDTYELRHKILRPNQPLEVCMYESDLLRGAFHLGGYYGGKLISIASFHQAEHPELQGQKQYQLRGVATLEGYRDQKAGSSLIRHAEEILRKRGADMLWCNARTSASGYYKKLGFSEQGEVFDTPPVGPHILMYKRIT

SEQ ID NO: 672 - DNA, 441 bp, Artificial Sequence
  Synthetic nucleic acid sequence
  CDS (1)...(441)
  D_GE002278_GAT20-24F8
atgatagaggtaaaaccgattaacgcagaggatacctatgaactaaggcatagagtcctcagaccaaaccagccgatagaagcgtgtatgtttgatagcgatttactgcgtggtgcatttcacttaggcggctactacgggggcaaactgatttccgtcgcttcattccaccaggccgagcactcggaacttcaaggccagaaacagtaccagcttcgaggtgtggctaccttggaaggttatcgtgagcagaaggcgggaaccagtctacttaaacacgctgaagaaattctacgtaagaggggggcggacatgctttggtgtaatgcgcggacatccgcctcaggcttctacagaaagttaggcttcagcgagcagggagaggtattcgacacgccgccagtaggacctcacatcctgatgtataaaaggatcacataa

SEQ ID NO: 673 - protein, 146 aa, Artificial Sequence
  D_GE002278_GAT20-24F8
  Synthetic Protein Sequence
MIEVKPINAEDTYELRHRVLRPNQPIEACMFDSDLLRGAFHLGGYYGGKLISVASFHQAEHSELQGQKQYQLRGVATLEGYREQKAGTSLLKHAEEILRKRGADMLWCNARTSASGFYRKLGFSEQGEVFDTPPVGPHILMYKRIT

SEQ ID NO: 674 - DNA, 441 bp, Artificial Sequence
  Synthetic nucleic acid sequence
  CDS (1)...(441)
  D_GE002279_GAT20-26A4
atgatagaggtaaaaccgattaacgcagaggatacctatgaactaaggcatagagtcctcagaccaaaccagccgatagaagcgtgtatgtttgaaagcgatttactgcgtggtgcatttcacttaggcggctactacgggggcaaactgatttccatcgcttcattccaccaggccgagcactcggaacttcaaggccagaaacagtaccagattcgaggtgtggctaccttggaaggttatcgtgagcagaaggcgggaaccagtctagttaaacacgctgaagaaattctacgtaagaggggggcggacctactttggtgtaatgcgcggacatccgcctcaggctactacagaaagttaggcttcagcgagcagggagagatattcgacacgccgccagtaggacctcacatcctgatgtataaaaggatcacataa

SEQ ID NO: 675 - protein, 146 aa, Artificial Sequence
  D_GE002279_GAT20-26A4
  Synthetic Protein Sequence
MIEVKPINAEDTYELRHRVLRPNQPIEACMFESDLLRGAFHLGGYYGGKLISIASFHQAEHSELQGQKQYQIRGVATLEGYREQKAGTSLVKHAEEILRKRGADLLWCNARTSASGYYRKLGFSEQGEIFDTPPVGPHILMYKRIT

SEQ ID NO: 676 - DNA, 441 bp, Artificial Sequence
  Synthetic nucleic acid sequence
  CDS (1)...(441)
  D_GE002280_GAT20-27C7
atgatagaggtaaaaccgattaacgcagaggatacctatgacctaaggcatagagtcctcagaccaaaccagccgatagaagcgtgtatgtttgatagcgatttactgcgtggtgcatttcacttaggcggcttctacgggggcagactgatttccgtcgcttcattccaccaggccgagcacacggaacttcaaggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggcttctacagaaagttaggcttcagcgagcagggagaggtattcgacacgccgccagtaggacctcacatcatgatgtataaaaggatcacataa

SEQ ID NO: 677 - protein, 146 aa, Artificial Sequence
  D_GE002280_GAT20-27C7
  Synthetic Protein Sequence
MIEVKPINAEDTYDLRHRVLRPNQPIEACMFDSDLLRGAFHLGGFYGGRLISVASFHQAEHTELQGQKQYQLRGVATLEGYREQKAGTSLVKHAEEILRKRGADMLWCNARTSASGFYRKLGFSEQGEVFDTPPVGPHIMMYKRIT

SEQ ID NO: 678 - DNA, 441 bp, Artificial Sequence
  Synthetic nucleic acid sequence
  CDS (1)...(441)
  D_GE002281_GAT20-27F9
atgatagaggtaaaaccgattaacgcagaggatacctatgacctaaggcatagagtcctcagaccaaaccagccgatagaagcgtgtatgtttgatagcgatttaatgcgtggtgcatttcacttaggcggctactacgggggcagactgatttccgtcgcttcattccaccaggccgagcactcggaatttcaaggccagaaacagtaccagcttcgaggtatggctaccttggaaggttatcgtgagcagaaggcgggatccagtctagttaaacacgctgaagaaattatacgtaagaggggggcggacctactttggtgtaatgcgcggacatccgcctcaggctactacagaaagttaggcttcagcgagcagggagagatattcgacacgccgccagtaggacctcacatcctgatgtataaaaggatcacataa

SEQ ID NO: 679 - protein, 146 aa, Artificial Sequence
  D_GE002281_GAT20-27F9
  Synthetic Protein Sequence
MIEVKPINAEDTYDLRHRVLRPNQPIEACMFDSDLMRGAFHLGGYYGGRLISVASFHQAEHSEFQGQKQYQLRGMATLEGYREQKAGSSLVKHAEEIIRKRGADLLWCNARTSASGYYRKLGFSEQGEIFDTPPVGPHILMYKRIT

SEQ ID NO: 680 - DNA, 441 bp, Artificial Sequence
  Synthetic nucleic acid sequence
  CDS (1)...(441)
  D_GE002282_GAT20-30B10
atgatagaggtaaaaccgattaacgcagaggatacctatgaactaaggcatagagtcctcagaccaaaccagccgatagaagcgtgtatgtttgatagcgatttactgcgtggtgcatttcacttaggcggctactacgggggcaaactgatttccatcgcttcattccaccaggccgagcacacggaacttcaaggccagaaacagtaccagcttcgaggtgtggctaccttggaaggttatcgtgagcagaaggcgggaactagtctagttaaacacgctgaagaaattctacgtaagaggggggcggacatgctttggtgtaatgcgcggacatccgcctcaggcttctacagaaagttaggcttcagcgagcagggagaggtattcgacacgccgccagtaggacctcacatcctgatgtataaaaggatcacataa

SEQ ID NO: 681 - protein, 146 aa, Artificial Sequence
  D_GE002282_GAT20-30B10
  Synthetic Protein Sequence
MIEVKPINAEDTYELRHRVLRPNQPIEACMFDSDLLRGAFHLGGYYGGKLISIASFHQAEHTELQGQKQYQLRGVATLEGYREQKAGTSLVKHAEEILRKRGADMLWCNARTSASGFYRKLGFSEQGEVFDTPPVGPHILMYKRIT

SEQ ID NO: 682 - DNA, 441 bp, Artificial Sequence
  Synthetic nucleic acid sequence
  CDS (1)...(441)
  D_GE002283_GAT20-30C6
atgatagaggtaaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggatccagtctagttaaacacgctgaagaaattctacgtaagaggggggcggacatactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 683 - protein, 146 aa, Artificial Sequence
  D_GE002283_GAT20-30C6
  Synthetic Protein Sequence
MIEVKPINAEDTYELRHRVLRPNQPIEACMFESDLLRGAFHLGGFYGGKLISVASFHQAEHTELQGQKQYQLRGVATLEGYREQKAGSSLVKHAEEILRKRGADILWCNARTSASGYYKKLGFSEQGEVFDTPPVGPHILMYKRIT

SEQ ID NO: 684 - DNA, 441 bp, Artificial Sequence
  Synthetic nucleic acid sequence
  CDS (1)...(441)
  D_GE003198_GAT20-30C6b
atgatagaggtaaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggttccagtctagttaaacacgctgaagaaattctacgtaagaggggggcggacatactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 685 - protein, 146 aa, Artificial Sequence
  D_GE003198_GAT20-30C6b
  Synthetic Protein Sequence
MIEVKPINAEDTYELRHRVLRPNQPIEACMFESDLLRGAFHLGGFYGGKLISVASFHQAEHSELQGQKQYQLRGVATLEGYREQKAGSSLVKHAEEILRKRGADILWCNARTSASGYYKKLGFSEQGEVFDTPPVGPHILMYKRIT

SEQ ID NO: 686 - DNA, 441 bp, Artificial Sequence; identical to SEQ ID NO: 624
  Synthetic nucleic acid sequence
  CDS (1)...(441)
  D_GE002284_GAT20-30F7

SEQ ID NO: 687 - protein, 146 aa, Artificial Sequence; identical to SEQ ID NO: 625
  D_GE002284_GAT20-30F7
  Synthetic Protein Sequence

SEQ ID NO: 688 - DNA, 441 bp, Artificial Sequence
  Synthetic nucleic acid sequence
  CDS (1)...(441)
  D_GE002285_GAT20-31D6
atgatagaggtaaaaccgattaacgcagaggatacctatgacctaaggcatagagtcctcagaccaaaccagccgatagaagcgtgtatctttgatagcgatttactgcgtggtgcatttcacttaggcggcttctacgggggcagactgatttccatcgcttcattccacccggccgagcactcggaacttcaaggccagaaacagtaccagcttcgaggtatggctaccttggaaggttatcgtgagcagaaggcgggatccagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcatgatgtataaaaggatcacataa

SEQ ID NO: 689 - protein, 146 aa, Artificial Sequence
  D_GE002285_GAT20-31D6
  Synthetic Protein Sequence
MIEVKPINAEDTYDLRHRVLRPNQPIEACIFDSDLLRGAFHLGGFYGGRLISIASFHPAEHSELQGQKQYQLRGMATLEGYREQKAGSSLVKHAEEILRKRGADLLWCNARTSASGYYRKLGFSEQGEVFDTPPVGPHIMMYKRIT

SEQ ID NO: 690 - DNA, 441 bp, Artificial Sequence
  Synthetic nucleic acid sequence
  CDS (1)...(441)
  D_GE002286_GAT20-31G1
atgatagaggtaaaaccgattaacgcagaggatacctatgacctaaggcatagagtcctcagaccaaaccagccgatagaagcgtgtatctttgaaagcgatttactgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggatccagtctagttaaacacgctgaagaaattctacgtaagaggggggcggacctgctttggtgtaatgcgcggacatccgcctcaggcttctacaaaaagttaggcttcagcgagcagggagaggtattcgacacgccgccagtaggacctcacatcatgatgtataaaaggatcacataa

SEQ ID NO: 691 - protein, 146 aa, Artificial Sequence
  D_GE002286_GAT20-31G1
  Synthetic Protein Sequence
MIEVKPINAEDTYDLRHRVLRPNQPIEACIFESDLLRGAFHLGGFYGGKLISVASFHQAEHSELQGQKQYQLRGVATLEGYREQKAGSSLVKHAEEILRKRGADLLWCNARTSASGFYKKLGFSEQGEVFDTPPVGPHIMMYKRIT

SEQ ID NO: 692 - DNA, 441 bp, Artificial Sequence
  Synthetic nucleic acid sequence
  CDS (1)...(441)
  D_S00339957_GAT19-1A7
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcagaactccaaggccagaaacagtaccagctccgaggtatggctaccttggaaggttatcgtgagcagaaagcgggatcgagtctagttaaacacgctgaagaaatcctccgtaagaggggggcggacttgctttggtgtaatgcgcggacatccgcctcaggctactacaaaaagttaggcttcagcgagcagggagaggtatttgatacgccgccagtaggacctcacatcctgatgtataaaaggatcacataa

SEQ ID NO: 693 - protein, 146 aa, Artificial Sequence
  D_S00339957_GAT19-1A7
  Synthetic Protein Sequence
MIEVKPINAEDTYELRHRILRPNQPIEACMFESDLLRGAFHLGGYYGGKLISIASFHQAEHSELQGQKQYQLRGMATLEGYREQKAGSSLVKHAEEILRKRGADLLWCNARTSASGYYKKLGFSEQGEVFDTPPVGPHILMYKRIT

SEQ ID NO: 694 - DNA, 441 bp, Artificial Sequence
  Synthetic nucleic acid sequence
  CDS (1)...(441)
  D_S00339989_GAT19-1D3
atgatagaagtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcttcattccaccaggccgagcactcagacctccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgcggacatccgcctcaggctactacaaaaagttaggcctcagcgagcagggagaggtatttgacacgccgccagtagggcctcacatcctgatgtataaaaggctcacataa

SEQ ID NO: 695 - protein, 146 aa, Artificial Sequence
  D_S00339989_GAT19-1D3
  Synthetic Protein Sequence
MIEVKPINAEDTYELRHRILRPNQPIEACMFESDLLRGAFHLGGFYGGKLISIASFHQAEHSDLQGQKQYQLRGMATLEGYREQKAGSTLVKHAEEILRKRGADMLWCNARTSASGYYKKLGLSEQGEVFDTPPVGPHILMYKRLT

SEQ ID NO: 696 - DNA, 441 bp, Artificial Sequence
  Synthetic nucleic acid sequence
  CDS (1)...(441)
  D_S00339991_GAT19-1D5
atgatagaagtgaaaccgattaacgcagaggatacctatgaactaaggcataaaatactcagaccaaaccagccgttagaagtgtgtatgtttgaaagcgatttacttcgcggtgcatttcacttaggcggctattacgggggcaaactgatttccatagcttcattccaccaggccgagcactcggaactccaaggccagaaacagtaccagctccgaggtatggctaccttggaaggttatcgtgagcagaaagcgggatcgagtctaattaaacacgctgaagaaattcttcgtaagaggggggtggacatgctttggtgtaatgcgcggacatccgcctcaggctactacaaaaagttaggcttcagcgagcagggagaggtattcgacacgccgccagtaggacctcacatcctgatgtataaaaggctcacataa

SEQ ID NO: 697 - protein, 146 aa, Artificial Sequence
  D_S00339991_GAT19-1D5
  Synthetic Protein Sequence
MIEVKPINAEDTYELRHKILRPNQPLEVCMFESDLLRGAFHLGGYYGGKLISIASFHQAEHSELQGQKQYQLRGMATLEGYREQKAGSSLIKHAEEILRKRGVDMLWCNARTSASGYYKKLGFSEQGEVFDTPPVGPHILMYKRLT

SEQ ID NO: 698 - DNA, 441 bp, Artificial Sequence
  Synthetic nucleic acid sequence
  CDS (1)...(441)
  D_S00340001_GAT19-1F3
atgatagaagtgaaaccgattaacgcagaggatacctatgaactaaggcataaaatactcagaccaaaccagccgttagaagtgtgtatgtatgaaaccgatttacttcgtggcgcatttcacttaggcggcttttacgggggcaaactgatttccatagcttcattccaccaggccgagcactcagacctccaaggccagaaacagtaccagctccgaggtatggctaccttggaaggttatcgtgatcagaaagcgggatcgagtctaattaaacacgctgaagaaattcttcgtaagaggggggcggacatgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 699 - protein, 146 aa, Artificial Sequence
  D_S00340001_GAT19-1F3
  Synthetic Protein Sequence
MIEVKPINAEDTYELRHKILRPNQPLEVCMYETDLLRGAFHLGGFYGGKLISIASFHQAEHSDLQGQKQYQLRGMATLEGYRDQKAGSSLIKHAEEILRKRGADMLWCNARTSASGYYKKLGFSEQGEVFDTPPVGPHILMYKRIT

SEQ ID NO: 700 - DNA, 441 bp, Artificial Sequence
  Synthetic nucleic acid sequence
  CDS (1)...(441)
  D_S00340013_GAT19-1G3
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcttcattccaccaggccgagcactcagaactccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgcggacatccgcctcaggctactacaaaaagttaggcttcagcgagcagggagaggtatttgacacgccgccagtaggacctcacatcctgatgtataaaaggatcacataa

SEQ ID NO: 701 - protein, 146 aa, Artificial Sequence
  D_S00340013_GAT19-1G3
  Synthetic Protein Sequence
MIEVKPINAEDTYELRHRILRPNQPIEACMFESDLLRGAFHLGGFYGGKLISIASFHQAEHSELQGQKQYQLRGMATLEGYREQKAGSTLVKHAEEILRKRGADMLWCNARTSASGYYKKLGFSEQGEVFDTPPVGPHILMYKRIT

SEQ ID NO: 702 - DNA, 441 bp, Artificial Sequence
  Synthetic nucleic acid sequence
  CDS (1)...(441)
  D_S00340017_GAT19-1G7
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcggaactccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgcggacatccgcctcaggctactacaaaaagttaggcttcggcgagcagggagaggtatttgaaacgccgccagtaggacctcacatcctgatgtataaaaggatcacataa

SEQ ID NO: 703 - protein, 146 aa, Artificial Sequence
  D_S00340017_GAT19-1G7
  Synthetic Protein Sequence
MIEVKPINAEDTYELRHRILRPNQPIEACMFESDLLRGAFHLGGYYGGKLISIASFHQAEHSELQGQKQYQLRGMATLEGYREQKAGSTLVKHAEEILRKRGADMLWCNARTSASGYYKKLGFGEQGEVFETPPVGPHILMYKRIT

SEQ ID NO: 704 - DNA, 441 bp, Artificial Sequence
  Synthetic nucleic acid sequence
  CDS (1)...(441)
  D_S00340201_GAT19-3H11
atgatagaagtgaaaccgattaacgcagaggatacctatgagctaaggcatagaatactcagaccaaaccagccgatagaagcgtgtatgtttgaaagcgatttacttcgtggtgcatttcacttaggcggcttttacgggggcaaactgatttccatagcttcattccaccaggccgagcactcggaactccaaggccagaaacagtaccagctccgaggtatggctaccttggaaggttatcgtgagcagaaagcgggatcaactctagttaaacacgctgaagaaattcttcgtaagaggggggcggacttgctttggtgtaatgcgcggacatccgcctcaggctactacaaaaagttaggcttcagcgagcagggagaggtatttgacacgccgccagtaggacctcacatcctgatgtataaaaggatcacataa

SEQ ID NO: 705 - protein, 146 aa, Artificial Sequence
  D_S00340201_GAT19-3H11
  Synthetic Protein Sequence
MIEVKPINAEDTYELRHRILRPNQPIEACMFESDLLRGAFHLGGFYGGKLISIASFHQAEHSELQGQKQYQLRGMATLEGYREQKAGSTLVKHAEEILRKRGADLLWCNARTSASGYYKKLGFSEQGEVFDTPPVGPHILMYKRIT

SEQ ID NO: 706 - DNA, 441 bp, Artificial Sequence
  Synthetic nucleic acid sequence
  CDS (1)...(441)
  D_S00340360_GAT19-5H2
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcagaactccaaggccagaaacagtaccagctccgaggtatggctaccttggaaggttatcgtgatcagaaagcgggatcgagtctagttagacacgctgaacaaattcttcgtaagaggggggcggacttgctttggtgtaatgcgcggacatccgcctcaggctactacaaaaagttaggcttcagtgagcagggagaggtattcgacacgccgccagtaggacctcacatcctgatgtataaaaggctcacataa

SEQ ID NO: 707 - protein, 146 aa, Artificial Sequence
  D_S00340360_GAT19-5H2
  Synthetic Protein Sequence
MIEVKPINAEDTYELRHRILRPNQPIEACMFESDLLRGAFHLGGYYGGKLISIASFHQAEHSELQGQKQYQLRGMATLEGYRDQKAGSSLVRHAEQILRKRGADLLWCNARTSASGYYKKLGFSEQGEVFDTPPVGPHILMYKRLT

SEQ ID NO: 708 - DNA, 441 bp, Artificial Sequence
  Synthetic nucleic acid sequence
  CDS (1)...(441)
  D_S00340389_GAT19-6B7
atgatagaagtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcagaactccaaggccagaaacagtaccagctccgaggtgtggctaccttggaaggttatcgtgagcagaaggcgggatcgagtctaattaaacacgctgaagaaattcttcgtaagaggggggcggacatgctttggtgtaatgcgcggacatccgcctcaggctactacaaaaagttaggcttcagcgagcagggagagatatttgacacgccgccagtaggaccccacatcctgatgtataaaaggatcacataa

SEQ ID NO: 709 - protein, 146 aa, Artificial Sequence
  D_S00340389_GAT19-6B7
  Synthetic Protein Sequence
MIEVKPINAEDTYELRHRILRPNQPIEACMFESDLLRGAFHLGGYYGGKLISIASFHQAEHSELQGQKQYQLRGVATLEGYREQKAGSSLIKHAEEILRKRGADMLWCNARTSASGYYKKLGFSEQGEIFDTPPVGPHILMYKRIT

SEQ ID NO: 710 - DNA, 441 bp, Artificial Sequence
  Synthetic nucleic acid sequence
  CDS (1)...(441)
  D_S00340420_GAT19-6F2
atgatagaagtgaaaccgattaacgcagaggatacctatgaactaaggcatagaatactcagaccaaaccagccgatagaagcgtgtatgtttgaaagcgatttgcttcgtggtgcatttcacttaggcggcttttacgggggcaaactgatttccatagcttcattccaccaggctgagcactcagaactccaaggccagaaacagtaccagctccgaggtgtggctaccttggaaggttatcgtgagcagaaagcgggatcgagtctaattaaacacgctgaagaaatccttcgtaagaggggggcggacttgctttggtgtaatgcgcgggcatccgcctcaggctactacaaaaagttaggcttcagcgagcagggagaggtatttgatacgccgccagtaggacctcacatcctgatgtataaaaggctcacataa

SEQ ID NO: 711 - protein, 146 aa, Artificial Sequence
  D_S00340420_GAT19-6F2
  Synthetic Protein Sequence
MIEVKPINAEDTYELRHRILRPNQPIEACMFESDLLRGAFHLGGFYGGKLISIASFHQAEHSELQGQKQYQLRGVATLEGYREQKAGSSLIKHAEEILRKRGADLLWCNARASASGYYKKLGFSEQGEVFDTPPVGPHILMYKRLT

SEQ ID NO: 712 - DNA, 441 bp, Artificial Sequence
  Synthetic nucleic acid sequence
  CDS (1)...(441)
  D_S00340423_GAT19-6F5
atgatagaagtgaaaccgattaacgcagaggatacctatgaactaaggcatagaatactcagaccaaaccagccgatagaagcgtgtatgtttgaaagcgatttacttcgtggtgcatttcacttaggcggctattacgggggcaaactgatttccatagcttcattccaccaggccgagcactcggaactccaaggccagaaacagtaccagctccgaggtgtggctaccttggaaggttatcgtgagcagaaggcgggatcgagtctaattaaacacgctgaagaaattcttcgtaagaggggggcggacatgctttggtgcaatgcgcggacatccgcctcaggctactacaaaaagttaggcttcagcgagcagggagaggtatttgaaacgccgccagtaggacctcacatcctgatgtataaaaggatcacataa

SEQ ID NO: 713 - protein, 146 aa, Artificial Sequence
  D_S00340423_GAT19-6F5
  Synthetic Protein Sequence
MIEVKPINAEDTYELRHRILRPNQPIEACMFESDLLRGAFHLGGYYGGKLISIASFHQAEHSELQGQKQYQLRGVATLEGYREQKAGSSLIKHAEEILRKRGADMLWCNARTSASGYYKKLGFSEQGEVFETPPVGPHILMYKRIT

SEQ ID NO: 714 - DNA, 441 bp, Artificial Sequence
  Synthetic nucleic acid sequence
  CDS (1)...(441)
  D_S00340426_GAT19-6F8
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacgggggcaaactgatttccatagcttcattccaccaggctgagcactcagaactccaaggccagaaacagtaccagctccgaggtatggctaccttggaaggttatcgtgagcagaaagcgggatcgagtctagttaaacacgctgaagaaatccttcgtaagaggggggcggacatgctttggtgtaatgcgcggacatccgcctcaggctactacaaaaagttaggcttcagcgagcagggagaggtatttgaaacgccgccagtaggacctcacatcctgatgtataaaaggatcacataa

SEQ ID NO: 715 - protein, 146 aa, Artificial Sequence
  D_S00340426_GAT19-6F8
  Synthetic Protein Sequence
MIEVKPINAEDTYELRHRILRPNQPIEACMFESDLLRGAFHLGGFYGGKLISIASFHQAEHSELQGQKQYQLRGMATLEGYREQKAGSSLVKHAEEILRKRGADMLWCNARTSASGYYKKLGFSEQGEVFETPPVGPHILMYKRIT

SEQ ID NO: 716 - DNA, 441 bp, Artificial Sequence
  Synthetic nucleic acid sequence
  CDS (1)...(441)
  D_S00340428_GAT19-6F10
atgatagaggtgaaaccgattaacgcagaggatacctatgaactaaggcataaaatactcagaccaaaccagccgatagaagcgtgtatgtttgaaagcgatttacttcgtggtgcatttcacttaggcggcttttacgggggcaaactgatttccatagcttcattccaccaggccgagcactcggaactccaaggccagaaacagtaccagctccgaggtatggctaccttggaaggttatcgtgagcagaaagcggggtcgagtctagttaaacacgctgaagaaatccttcgtaagaggggggcggacatgctttggtgtaatgcgcggacatccgcctcaggctactacaagaagttaggcttcagcgagcagggagaggtatttgaaacgccgccagtaggacctcacatcctgatgtataaaaggatcacataa

SEQ ID NO: 717 - protein, 146 aa, Artificial Sequence
  D_S00340428_GAT19-6F10
  Synthetic Protein Sequence
MIEVKPINAEDTYELRHKILRPNQPIEACMFESDLLRGAFHLGGFYGGKLISIASFHQAEHSELQGQKQYQLRGMATLEGYREQKAGSSLVKHAEEILRKRGADMLWCNARTSASGYYKKLGFSEQGEVFETPPVGPHILMYKRIT

SEQ ID NO: 718 - DNA, 441 bp, Artificial Sequence
  Synthetic nucleic acid sequence
  CDS (1)...(441)
  D_S00340436_GAT19-6G6
atgatagaagtgaaaccgattaacgcagaggatacctatgaactaaggcataaaatactcagaccaaaccagccgatagaagcgtgtatgtttgaaagcgatttacttcgtggtgcatttcacttaggcggcttttacaggggcaaactgatttccatagcttcattccaccaggccgagcactcggaactccaaggccagaaacagtaccagctccgaggtgtggctaccttggaaggttatcgtgagcagaaagcgggatcgagtctaattaaacacgctgaagaaatccttcgtaagaggggggcggacatgctttggtgcaatgcgcggacatccgcctcaggctactacaaaaagttaggcttcagcgagcagggagaggtatttgacacgccgccagtaggacctcacatcctgatgtataaaaggatcacataa

SEQ ID NO: 719 - protein, 146 aa, Artificial Sequence
  D_S00340436_GAT19-6G6
  Synthetic Protein Sequence
MIEVKPINAEDTYELRHKILRPNQPIEACMFESDLLRGAFHLGGFYRGKLISIASFHQAEHSELQGQKQYQLRGVATLEGYREQKAGSSLIKHAEEILRKRGADMLWCNARTSASGYYKKLGFSEQGEVFDTPPVGPHILMYKRIT

SEQ ID NO: 720 - DNA, 441 bp, Artificial Sequence
  Synthetic nucleic acid sequence
  CDS (1)...(441)
  D_S00340437_GAT19-6G7
atgatagaggtgaaaccgattaacgcagaggatacctatgaactaaggcatagaatactcagaccaaaccagccgatagaagcgtgtatgtttgaaagcgatttacttcgtggtgcatttcacttaggcggctattacaggggcaaactggtttccatagcttcattccaccaggccgagcactcagacctccaaggccagaaacagtaccagctccgaggtatggctaccttggaaggttatcgtgagcagaaggcgggatcgagtctaattaaacacgctgaagaaattcttcgtaagaggggggcggacatgctttggtgtaatgcgcggacatccgcctcaggctactacaaaaagttaggcttcagcgagcagggagaggtatttgaaacgccgccagtaggacctcacatcctgatgtataaaaggctcacataa

SEQ ID NO: 721 - protein, 146 aa, Artificial Sequence
  D_S00340437_GAT19-6G7
  Synthetic Protein Sequence
MIEVKPINAEDTYELRHRILRPNQPIEACMFESDLLRGAFHLGGYYRGKLVSIASFHQAEHSDLQGQKQYQLRGMATLEGYREQKAGSSLIKHAEEILRKRGADMLWCNARTSASGYYKKLGFSEQGEVFETPPVGPHILMYKRLT

SEQ ID NO: 722 - DNA, 441 bp, Artificial Sequence; identical to SEQ ID NO: 638
  Synthetic nucleic acid sequence
  CDS (1)...(441)
  D_S00341190_GAT20-1F8

SEQ ID NO: 723 - protein, 146 aa, Artificial Sequence; identical to SEQ ID NO: 639
  D_S00341190_GAT20-1F8
  Synthetic Protein Sequence

SEQ ID NO: 724 - DNA, 441 bp, Artificial Sequence; identical to SEQ ID NO: 674
  Synthetic nucleic acid sequence
  CDS (1)...(441)
  D_S00341206_GAT20-1G12

SEQ ID NO: 725 - protein, 146 aa, Artificial Sequence; identical to SEQ ID NO: 675
  D_S00341206_GAT20-1G12
  Synthetic Protein Sequence

SEQ ID NO: 726 - DNA, 441 bp, Artificial Sequence
  Synthetic nucleic acid sequence
  CDS (1)...(441)
  D_S00341290_GAT20-2G12
atgatagagataaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggtactagtctagttaaacacgctgaagaaattctacgtaagaggggggcggacatgctttggtgtaatgcgcggacatccgcctcaggctactacaaaaagttaggcttcagcgagcagggagaggtattcgacacgccgccagtaggacctcacatcatgatgtataaaaggatcacataa

SEQ ID NO: 727 - protein, 146 aa, Artificial Sequence
  D_S00341290_GAT20-2G12
  Synthetic Protein Sequence
MIEIKPINAEDTYDLRHRVLRPNQPIEACMFDSDLMRGAFHLGGFYGGKLISVASFHQAEHSELQGQKQYQLRGMATLEGYREQKAGTSLVKHAEEILRKRGADMLWCNARTSASGYYKKLGFSEQGEVFDTPPVGPHIMMYKRIT

SEQ ID NO: 728 - DNA, 441 bp, Artificial Sequence
  Synthetic nucleic acid sequence
  CDS (1)...(441)
  D_S00341421_GAT20-4C11
atgatagaggtaaaaccgattaacgcagaggatacctatgaactaaggcatagagtcctcagaccaaaccagccgatagaagcgtgtatctttgaaagcgatttactgcgtggtgcatttcacttaggcggctactacgggggcaaactgatatccatcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacctactttggtgtaatgcgcggacatccgcctcaggctactacagaaagttaggcttcagcgagcaaggagaggtattcgacacgccgccagtaggacctcacatcatgatgtataaaaggatcacataa

SEQ ID NO: 729 - protein, 146 aa, Artificial Sequence
  D_S00341421_GAT20-4C11
  Synthetic Protein Sequence
MIEVKPINAEDTYELRHRVLRPNQPIEACIFESDLLRGAFHLGGYYGGKLISIASFHQAEHSELQGQKQYQLRGMATLEGYREQKAGTSLVKHAEEILRKRGADLLWCNARTSASGYYRKLGFSEQGEVFDTPPVGPHIMMYKRIT

SEQ ID NO: 730 - DNA, 441 bp, Artificial Sequence
  Synthetic nucleic acid sequence
  CDS (1)...(441)
  D_S00341448_GAT20-4G2
atgatagaggtaaaaccgattaacgcagaggatacctatgacctaaggcatagagtcctcagaccaaaccagccgatagaagcgtgtatgtttgatagcgatttactgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggatccagtctagttaaacacgctgaagaaattatacgtaagaggggggcggacctgctttggtgtaatgcgcggacatccgcctcaggctactacagaaagttaggcttcagcgagcagggagaggtattcgacacgccgccagtaggacctcacatcatgatgtataaaaggatcacataa

SEQ ID NO: 731 - protein, 146 aa, Artificial Sequence
  D_S00341448_GAT20-4G2
  Synthetic Protein Sequence
MIEVKPINAEDTYDLRHRVLRPNQPIEACMFDSDLLRGAFHLGGFYGGRLISVASFHQAEHSELQGQKQYQLRGMATLEGYREQKAGSSLVKHAEEIIRKRGADLLWCNARTSASGYYRKLGFSEQGEVFDTPPVGPHIMMYKRIT

SEQ ID NO: 732 - DNA, 441 bp, Artificial Sequence
  Synthetic nucleic acid sequence
  CDS (1)...(441)
  D_S00341692_GAT20-7F6
atgatagaggtaaaaccgattaacgcagaggatacctatgacctaaggcatagagtcctcagaccaaaccagccgatagaagcgtgtatgtttgatagcgatttactgcgtggtgcatttcacttaggcggcttctacgggggcaaactgatttccgtcgcttcattccaccaggccgagcacttggaacttcaaggccagaaacagtaccagattcgaggtgtggctaccttggaaggttatcgtgagcagaaggcgggaaccagtctagttaaacacgctgaagaaattctacgtaagaggggggcggacctgctttggtgtaatgcgcggacatccgcctcaggctactacagaaagttaggcttcagcgagcagggagagatattcgacacgccgccagtaggacctcacatcctgatgtataaaaggatcacataa

SEQ ID NO: 733 - protein, 146 aa, Artificial Sequence
  D_S00341692_GAT20-7F6
  Synthetic Protein Sequence
MIEVKPINAEDTYDLRHRVLRPNQPIEACMFDSDLLRGAFHLGGFYGGKLISVASFHQAEHLELQGQKQYQIRGVATLEGYREQKAGTSLVKHAEEILRKRGADLLWCNARTSASGYYRKLGFSEQGEIFDTPPVGPHILMYKRIT

SEQ ID NO: 734 - DNA, 441 bp, Artificial Sequence; identical to SEQ ID NO: 624
  Synthetic nucleic acid sequence
  CDS (1)...(441)
  D_S00341732_GAT20-8A10

SEQ ID NO: 735 - protein, 146 aa, Artificial Sequence; identical to SEQ ID NO: 625
  D_S00341732_GAT20-8A10
  Synthetic Protein Sequence

SEQ ID NO: 736 - DNA, 441 bp, Artificial Sequence
  Synthetic nucleic acid sequence
  CDS (1)...(441)
  D_S00341794_GAT20-8G12
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaaattcaaggccagaaacagtaccagcttcgaggtatggctaccttggaaggttatcgtgagcagaaggcgggaaccagtctagttaaacacgctgaagaaattctacgtaagaggggggcggacctactttggtgtaatgcgcggacatccgcctcaggctactacagaaagttaggcttcagcgagcagggagagatattcgacacgccgccagtaggacctcacatcatgatgtataaaaggatcacataa

SEQ ID NO: 737 - protein, 146 aa, Artificial Sequence
  D_S00341794_GAT20-8G12
  Synthetic Protein Sequence
MIEVKPINAEDTYDLRHRVLRPNQPIEACMFESDLMRGAFHLGGFYGGKLISVASFHQAEHSEIQGQKQYQLRGMATLEGYREQKAGTSLVKHAEEILRKRGADLLWCNARTSASGYYRKLGFSEQGEIFDTPPVGPHIMMYKRIT

SEQ ID NO: 738 - DNA, 441 bp, Artificial Sequence; identical to SEQ ID NO: 660
  Synthetic nucleic acid sequence
  CDS (1)...(441)
  D_S00341806_GAT20-8H12

SEQ ID NO: 739 - protein, 146 aa, Artificial Sequence; identical to SEQ ID NO: 661
  D_S00341806_GAT20-8H12
  Synthetic Protein Sequence

SEQ ID NO: 740 - DNA, 441 bp, Artificial Sequence
  Synthetic nucleic acid sequence
  CDS (1)...(441)
  D_S00375329_GAT20-8H12b
atgatagaggtaaaaccgattaacgcagaggatacctatgaactaaggcatagagtcctcagaccaaaccagccgatagaagcgtgtatctttgaaagcgatttaatgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 741 - protein, 146 aa, Artificial Sequence; identical to SEQ ID NO: 661
  D_S00375329_GAT20-8H12b
  Synthetic Protein Sequence

SEQ ID NO: 742 - DNA, 441 bp, Artificial Sequence; identical to SEQ ID NO: 654
  Synthetic nucleic acid sequence
  CDS (1)...(441)
  D_S00341822_GAT20-9B4

SEQ ID NO: 743 - protein, 146 aa, Artificial Sequence; identical to SEQ ID NO: 655
  D_S00341822_GAT20-9B4
  Synthetic Protein Sequence

SEQ ID NO: 744 - DNA, 441 bp, Artificial Sequence; identical to SEQ ID NO: 660
  Synthetic nucleic acid sequence
  CDS (1)...(441)
  D_S00342013_GAT20-11D3

SEQ ID NO: 745 - protein, 146 aa, Artificial Sequence; identical to SEQ ID NO: 661
  D_S00342013_GAT20-11D3
  Synthetic Protein Sequence

SEQ ID NO: 746 - DNA, 441 bp, Artificial Sequence; identical to SEQ ID NO: 728
  Synthetic nucleic acid sequence
  CDS (1)...(441)
  D_S00342016_GAT20-11D6

SEQ ID NO: 747 - protein, 146 aa, Artificial Sequence; identical to SEQ ID NO: 729
  D_S00342016_GAT20-11D6
  Synthetic Protein Sequence

SEQ ID NO: 748 - DNA, 441 bp, Artificial Sequence
  Synthetic nucleic acid sequence
  CDS (1)...(441)
  D_S00392016_GAT22-1C12
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggtactagtctagttaaacacgctgaagaaattctacgtaagaggggggtggacctactttggtgtaatgcgcggacatccgcctcaggctactacagaaagttaggcttcagcgagcagggagagatattcgacacgccgccagtaggacctcacatcctgatgtataaaaggatcacataa

SEQ ID NO: 749 - protein, 146 aa, Artificial Sequence
  D_S00392016_GAT22-1C12
  Synthetic Protein Sequence
MIEVKPINAEDTYDLRHRVLRPNQPIEACMFDSDLMRGAFHLGGFYGGRLISVASFHQAEHSELQGQKQYQLRGMATLEGYREQKAGTSLVKHAEEILRKRGVDLLWCNARTSASGYYRKLGFSEQGEIFDTPPVGPHILMYKRIT

SEQ ID NO: 750 - DNA, 441 bp, Artificial Sequence
  Synthetic nucleic acid sequence
  CDS (1)...(441)
  D_S00392026_22-1D10
atgatagagataaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 751 - protein, 146 aa, Artificial Sequence
  D_S00392026_22-1D10
  Synthetic Protein Sequence
MIEIKPINAEDTYDLRHRVLRPNQPIEACMFESDLMRGAFHLGGFYGGKLISVASFHQAEHSELQGQKQYQLRGMATLEGYREQKAGSSLVKHAEEILRKRGADLLWCNARTSASGYYRKLGFSEQGEVFDTPPVGPHILMYKRIT

SEQ ID NO: 752 - DNA, 441 bp, Artificial Sequence
  Synthetic nucleic acid sequence
  CDS (1)...(441)
  D_S00392111_GAT22-2D11
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggtggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 753 - protein, 146 aa, Artificial Sequence
  D_S00392111_GAT22-2D11
  Synthetic Protein Sequence
MIEVKPINAEDTYDLRHRVLRPNQPIEACMFESDLMRGAFHLGGFYGGKLISVASFHQAEHSELQGQKQYQLRGVATLEGYREQKAGTSLVKHAEEILRKRGVDLLWCNARTSASGYYRKLGFSEQGEVFDTPPVGPHILMYKRIT

SEQ ID NO: 754 - DNA, 441 bp, Artificial Sequence
  Synthetic nucleic acid sequence
  CDS (1)...(441)
  D_S00392304_GAT22-4G12
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacatactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 755 - protein, 146 aa, Artificial Sequence
  D_S00392304_GAT22-4G12
  Synthetic Protein Sequence
MIEVKPINAEDTYDLRHRVLRPNQPIEACMFDSDLMRGAFHLGGFYGGKLISVASFHQAEHSELQGQKQYQLRGMATLEGYREQKAGSSLVKHAEEILRKRGADILWCNARTSASGYYRKLGFSEQGEVFDTPPVGPHILMYKRIT

SEQ ID NO: 756 - DNA, 441 bp, Artificial Sequence
  Synthetic nucleic acid sequence
  CDS (1)...(441)
  D_S00392376_GAT22-5F12
atgatagaggtaaaaccgattaacgcagaggatacctatgacctaaggcatagagtcctcagaccaaaccagccgatagaagcgtgtatctttgaaagtgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 757 - protein, 146 aa, Artificial Sequence
  D_S00392376_GAT22-5F12
  Synthetic Protein Sequence
MIEVKPINAEDTYDLRHRVLRPNQPIEACIFESDLMRGAFHLGGFYGGKLISVASFHQAEHSELQGQKQYQLRGMATLEGYREQKAGSSLVKHAEEILRKRGADLLWCNARTSASGYYRKLGFSEQGEVFDTPPVGPHILMYKRIT

SEQ ID NO: 758 - DNA, 441 bp, Artificial Sequence
  Synthetic nucleic acid sequence
  CDS (1)...(441)
  D_S00392449_GAT22-6F1
atgatagaggtaaaaccgattaacgcagaggatacctatgacctaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggtactagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 759 - protein, 146 aa, Artificial Sequence
  D_S00392449_GAT22-6F1
  Synthetic Protein Sequence
MIEVKPINAEDTYDLRHRVLRPNQPIEACMFESDLLRGAFHLGGFYGGKLISVASFHQAEHSELQGQKQYQLRGMATLEGYREQKAGTSLVKHAEEILRKRGADMLWCNARTSASGYYRKLGFSEQGEVFDTPPVGPHILMYKRIT

SEQ ID NO: 760 - DNA, 441 bp, Artificial Sequence
  Synthetic nucleic acid sequence
  CDS (1)...(441)
  D_S00392474_GAT22-6H2
atgatagaggtaaaaccgattaacgcagaggatacctatgaactaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 761 - protein, 146 aa, Artificial Sequence
  D_S00392474_GAT22-6H2
  Synthetic Protein Sequence
MIEVKPINAEDTYELRHRVLRPNQPIEACMFDSDLMRGAFHLGGFYGGKLISVASFHQAEHSELQGQKQYQLRGMATLEGYREQKAGTSLVKHAEEILRKRGADMLWCNARTSASGYYRKLGFSEQGEVFDTPPVGPHILMYKRIT

SEQ ID NO: 762 - DNA, 441 bp, Artificial Sequence
  Synthetic nucleic acid sequence
  CDS (1)...(441)
  D_S00392595_GAT22-8C3
atgatagaggtaaaaccgattaacgcagaggatacctatgacctaaggcatagagtcctcagaccaaaccagccgatagaagcgtgtatctttgaaagcgatttaatgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggtggacatactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 763 - protein, 146 aa, Artificial Sequence
  D_S00392595_GAT22-8C3
  Synthetic Protein Sequence
MIEVKPINAEDTYDLRHRVLRPNQPIEACIFESDLMRGAFHLGGFYGGRLISVASFHQAEHSELQGQKQYQLRGMATLEGYREQKAGTSLVKHAEEILRKRGVDILWCNARTSASGYYRKLGFSEQGEVFDTPPVGPHILMYKRIT

SEQ ID NO: 764 - DNA, 441 bp, Artificial Sequence
  Synthetic nucleic acid sequence
  CDS (1)...(441)
  D_S00392619_22-8F3
atgatagagataaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggtactagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 765 - protein, 146 aa, Artificial Sequence
  D_S00392619_22-8F3
  Synthetic Protein Sequence
MIEIKPINAEDTYELRHRVLRPNQPIEACMFESDLLRGAFHLGGFYGGKLISVASFHQAEHSELQGQKQYQLRGMATLEGYREQKAGTSLVKHAEEILRKRGADLLWCNARTSASGYYRKLGFSEQGEVFDTPPVGPHILMYKRIT

SEQ ID NO: 766 - DNA, 441 bp, Artificial Sequence
  Synthetic nucleic acid sequence
  CDS (1)...(441)
  D_S00392706_GAT22-9F6
atgatagaggtaaaaccgattaacgcagaggatacctatgaactaaggcatagagtcctcagaccaaaccagccgatagaagcgtgtatgtttgatagcgatttactgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 767 - protein, 146 aa, Artificial Sequence
  D_S00392706_GAT22-9F6
  Synthetic Protein Sequence
MIEVKPINAEDTYELRHRVLRPNQPIEACMFDSDLLRGAFHLGGFYGGRLISVASFHQAEHSELQGQKQYQLRGMATLEGYREQKAGTSLVKHAEEILRKRGADLLWCNARTSASGYYRKLGFSEQGEVFDTPPVGPHILMYKRIT

SEQ ID NO: 768 - DNA, 441 bp, Artificial Sequence
  Synthetic nucleic acid sequence
  CDS (1)...(441)
  D_S00392922_22-12B6
atgatagaggtaaaaccgattaacgcagaggatacctatgaactaaggcatagagtcctcagaccaaaccagccgatagaagcgtgtatgtttgatagcgatttaatgcgtggtgcattgcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggcggacatgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 769 - protein, 146 aa, Artificial Sequence
  D_S00392922_22-12B6
  Synthetic Protein Sequence
MIEVKPINAEDTYELRHRVLRPNQPIEACMFDSDLMRGALHLGGFYGGKLISVASFHQAEHSELQGQKQYQLRGMATLEGYREQKAGTSLVKHAEEILRKRGADMLWCNARTSASGYYKKLGFSEQGEVFDTPPVGPHILMYKRIT

SEQ ID NO: 770 - DNA, 441 bp, Artificial Sequence
  Synthetic nucleic acid sequence
  CDS (1)...(441)
  D_S00397347_21-15C11
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 771 - protein, 146 aa, Artificial Sequence
  D_S00397347_21-15C11
  Synthetic Protein Sequence
MIEVKPINAEDTYDLRHRVLRPNQPIEACMFDSDLMRGAFHLGGFYGGKLISVASFHQAEHSELQGQKQYQLRGVATLEGYREQKAGTSLVKHAEEILRKRGADLLWCNARTSASGYYRKLGFSEQGEVFDTPPVGPHILMYKRIT

SEQ ID NO: 772 - DNA, 441 bp, Artificial Sequence
  Synthetic nucleic acid sequence
  CDS (1)...(441)
  D_S00397467_21-16G11
atgatagaggtaaaaccgattaacgcagaggatacctatgacctaaggcatagagtcctcagaccaaaccagccgatagaagcgtgtatgtttgaaagcgatttaatgcgtggtgcatttcacttaggtggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 773 - protein, 146 aa, Artificial Sequence
  D_S00397467_21-16G11
  Synthetic Protein Sequence
MIEVKPINAEDTYDLRHRVLRPNQPIEACMFESDLMRGAFHLGGFYGGKLISVASFHQAEHSELQGQKQYQLRGVATLEGYREQKAGTSLVKHAEEILRKRGADMLWCNARTSASGYYRKLGFSEQGEVFDTPPVGPHILMYKRIT

SEQ ID NO: 774 - DNA, 441 bp, Artificial Sequence
  Synthetic nucleic acid sequence
  CDS (1)...(441)
  D_S00397517_GAT21-17D1
atgatagaggtaaaaccgattaacgcagaggatacctatgaactaaggcatagagtcctcagaccaaaccagccgatagaagcgtgtatgtttgaaagcgatttaatgcgtggtgcatttcacttaggcggcttctacgggggcaaactgatttccatcgcttcattccaccaggccgagcactcggaacttcaaggccagaaacagtaccagcttcgaggtgtggctaccttagaaggttatcgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 775 - protein, 146 aa, Artificial Sequence
  D_S00397517_GAT21-17D1
  Synthetic Protein Sequence
MIEVKPINAEDTYELRHRVLRPNQPIEACMFESDLMRGAFHLGGFYGGKLISIASFHQAEHSELQGQKQYQLRGVATLEGYREQKAGTSLVKHAEEILRKRGADMLWCNARTSASGYYRKLGFSEQGEVFDTPPVGPHILMYKRIT

SEQ ID NO: 776 - DNA, 441 bp, Artificial Sequence
  Synthetic nucleic acid sequence
  CDS (1)...(441)
  D_S00397574_GAT21-18A10
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacatgctttggtgtaatgcgcggacatccgcctcaggctactacaaaaagttaggcttcagcgagcagggagaggtattcgacacgccgccagtagggcctcacatcctgatgtataaaaggatcacataa

SEQ ID NO: 777 - protein, 146 aa, Artificial Sequence
  D_S00397574_GAT21-18A10
  Synthetic Protein Sequence
MIEVKPINAEDTYDLRHRVLRPNQPIEACMFDSDLMRGAFHLGGFYGGKLISVASFHQAEHSELQGQKQYQLRGMATLEGYREQKAGSSLVKHAEEILRKRGADMLWCNARTSASGYYKKLGFSEQGEVFDTPPVGPHILMYKRIT

SEQ ID NO: 778 - DNA, 441 bp, Artificial Sequence
  Synthetic nucleic acid sequence
  CDS (1)...(441)
  D_S00397585_GAT21-18B9
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtatggctaccttagaaggttatcgtgagcagaaggcgggttccagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 779 - protein, 146 aa, Artificial Sequence
  D_S00397585_GAT21-18B9
  Synthetic Protein Sequence
MIEVKPINAEDTYDLRHRVLRPNQPIEACMFDSDLMRGAFHLGGFYGGKLISVASFHQAEHSELQGQKQYQLRGMATLEGYREQKAGSSLVKHAEEILRKRGADLLWCNARTSASGYYRKLGFSEQGEVFDTPPVGPHILMYKRIT

SEQ ID NO: 780 - DNA, 441 bp, Artificial Sequence
  Synthetic nucleic acid sequence
  CDS (1)...(441)
  D_S00397672_22-13B12
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacatactttggtgtaatgcgcggacatcggcctcaggctactacagaaagttaggcttcagcgagcagggagaggtattcgacacgccgccagtaggacctcacatcctgatgtataaaaggatcacataa

SEQ ID NO: 781 - protein, 146 aa, Artificial Sequence
  D_S00397672_22-13B12
  Synthetic Protein Sequence
MIEVKPINAEDTYDLRHRVLRPNQPIEACMFESDLMRGAFHLGGFYGGKLISVASFHQAEHSELQGQKQYQLRGMATLEGYREQKAGSSLVKHAEEILRKRGADILWCNARTSASGYYRKLGFSEQGEVFDTPPVGPHILMYKRIT

SEQ ID NO: 782 - DNA, 441 bp, Artificial Sequence
  Synthetic nucleic acid sequence
  CDS (1)...(441)
  D_S00397680_GAT22-13C8
atgatagaggtaaaaccgattaacgcagaggatacctatgacctaaggcatagagttctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggaaccagtctagttaaacacgctgaagaaattctacgtaagaggggggtggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 783 - protein, 146 aa, Artificial Sequence
  D_S00397680_GAT22-13C8
  Synthetic Protein Sequence
MIEVKPINAEDTYDLRHRVLRPNQPIEACMFDSDLMRGAFHLGGFYGGKLISVASFHQAEHSELQGQKQYQLRGMATLEGYREQKAGTSLVKHAEEILRKRGVDLLWCNARTSASGYYRKLGFSEQGEVFDTPPVGPHILMYKRIT

SEQ ID NO: 784 - DNA, 441 bp, Artificial Sequence
  Synthetic nucleic acid sequence
  CDS (1)...(441)
  D_S00397762_GAT22-14C6
atgatagaggtaaaaccgattaacgcagaggatacctatgacctaaggcatagagtcctcagaccaaaccagccgatagaagcgtgtatctttgaaagcgatttactgcgcggtgcatttcacttagggggcttctacgggggcaaactgatttccgtcgcttcattccaccaggccgagcactcggaacttcaaggccagaaacagtaccagcttcgaggtatggctaccttggaaggttatcgtgagcagaaggcgggtactagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 785 - protein, 146 aa, Artificial Sequence
  D_S00397762_GAT22-14C6
  Synthetic Protein Sequence
MIEVKPINAEDTYDLRHRVLRPNQPIEACIFESDLLRGAFHLGGFYGGKLISVASFHQAEHSELQGQKQYQLRGMATLEGYREQKAGTSLVKHAEEILRKRGADMLWCNARTSASGYYRKLGFSEQGEVFDTPPVGPHILMYKRIT

SEQ ID NO: 786 - DNA, 441 bp, Artificial Sequence
  Synthetic nucleic acid sequence
  CDS (1)...(441)
  D_S00397779_GAT22-14D11
atgatagaggtaaaaccgattaacgcagaggatacctatgacctaaggcatagagtcctcagaccaaaccagccgatagaagcgtgtatgtttgatagtgatttaatgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcctaatgtataaaaggatcacataa

SEQ ID NO: 787 - protein, 146 aa, Artificial Sequence; identical to SEQ ID NO: 779
  D_S00397779_GAT22-14D11
  Synthetic Protein Sequence

SEQ ID NO: 788 - DNA, 441 bp, Artificial Sequence
  Synthetic nucleic acid sequence
  CDS (1)...(441)
  D_S00397832_GAT22-15B4
atgatagaggtaaaaccgattaacgcagaagatacctatgacctaaggcatagagtcctcagaccaaaccagccgatagaagcgtgtatgtttgatagcgatttaatgcgtagtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggtggacctactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 789 - protein, 146 aa, Artificial Sequence
  D_S00397832_GAT22-15B4
  Synthetic Protein Sequence
MIEVKPINAEDTYDLRHRVLRPNQPIEACMFDSDLMRSAFHLGGFYGGKLISVASFHQAEHTELQGQKQYQLRGVATLEGYREQKAGSSLVKHAEEILRKRGVDLLWCNARTSASGYYKKLGFSEQGEVFDTPPVGPHILMYKRIT

SEQ ID NO: 790 - DNA, 441 bp, Artificial Sequence
  Synthetic nucleic acid sequence
  CDS (1)...(441)
  D_S00397844_GAT22-15C4
atgatagaggtaaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggtactagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 791 - protein, 146 aa, Artificial Sequence
  D_S00397844_GAT22-15C4
  Synthetic Protein Sequence
MIEVKPINAEDTYELRHRVLRPNQPIEACMFESDLLRGAFHLGGFYGGKLISVASFHQAEHSELQGQKQYQLRGMATLEGYREQKAGTSLVKHAEEILRKRGADLLWCNARTSASGYYRKLGFSEQGEVFDTPPVGPHILMYKRIT

SEQ ID NO: 792 - DNA, 441 bp, Artificial Sequence
  Synthetic nucleic acid sequence
  CDS (1)...(441)
  D_S00397944_22-16D8
atgatagaggtaaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggctactacagaaagttaggctttagcgagcagggagaggtattcgacacgccgccagtaggacctcacatcctgatgtataaaaggatcacataa

SEQ ID NO: 793 - protein, 146 aa, Artificial Sequence
  D_S00397944_22-16D8
  Synthetic Protein Sequence
MIEVKPINAEDTYELRHRVLRPNQPIEACMFESDLLRGAFHLGGFYGGKLISVASFHQAEHTELQGQKQYQLRGVATLEGYREQKAGTSLVKHAEEILRKRGADMLWCNARTSASGYYRKLGFSEQGEVFDTPPVGPHILMYKRIT

SEQ ID NO: 794 - DNA, 441 bp, Artificial Sequence
  Synthetic nucleic acid sequence
  CDS (1)...(441)
  D_S00398097_GAT22-18C5
atgatagaggtaaaaccgattaacgcagaggatacctatgacctaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcactcggaacttcaaggccagaaacagtatcagcttcgaggtgtggctaccttggaaggttatcgtgagcagaaggcgggaaccagtctagttaaacacgctgaagaaattctacgtaagaggggggtggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 795 - protein, 146 aa, Artificial Sequence
  D_S00398097_GAT22-18C5
  Synthetic Protein Sequence
MIEVKPINAEDTYDLRHRVLRPNQPIEACMFESDLTRGAFHLGGFYGGKLISVASFHQAEHSELQGQKQYQLRGVATLEGYREQKAGTSLVKHAEEILRKRGVDLLWCNARTSASGYYRKLGFSEQGEVFDTPPVGPHILMYKRIT

SEQ ID NO: 796 - DNA, 441 bp, Artificial Sequence
  Synthetic nucleic acid sequence
  CDS (1)...(441)
  D_S00398147_22-18H7
atgatagaggtaaaaccgattaacgcagaggatacctatgacctaaggcatagagtcctcagaccaaaccagccgatagaagcgtgtatctttgaaagcgatttaatgcgtggtgcatttcacttaggcggcttctacgggggcaaactgatttccgtcgcttcattccaccaggccgagcactcggaacttcagggccagaaacagtaccagcttcgaggtatggctaccttggaaggttatcgtgagcagaaggcgggttccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtatagaaggatcacataa

SEQ ID NO: 797 - protein, 146 aa, Artificial Sequence
  D_S00398147_22-18H7
  Synthetic Protein Sequence
MIEVKPINAEDTYDLRHRVLRPNQPIEACIFESDLMRGAFHLGGFYGGKLISVASFHQAEHSELQGQKQYQLRGMATLEGYREQKAGSSLVKHAEEILRKRGADMLWCNARTSASGYYRKLGFSEQGEVFDTPPVGPHILMYRRIT

SEQ ID NO: 798 - DNA, 441 bp, Artificial Sequence
  Synthetic nucleic acid sequence
  CDS (1)...(441)
  D_S00398975_21-19F1
atgatagaggtaaaaccgattaacgcagaggatacctatgacctaaggcatagagtcctcagaccaaaccagccgatagaagcgtgtatctttgaaagcgatttactgcgtggtgcatttcacctaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctgctttggtgtaatgcgcggacatccgcctcaggctactacagaaagttaggcttcagcgagcagggagaggtattcgacacgccaccagtaggacctcacatcctgatgtataaaaggatcacataa

SEQ ID NO: 799 - protein, 146 aa, Artificial Sequence
  D_S00398975_21-19F1
  Synthetic Protein Sequence
MIEVKPINAEDTYDLRHRVLRPNQPIEACIFESDLLRGAFHLGGFYGGKLISVASFHQAEHSELQGQKQYQLRGMATLEGYREQKAGSSLVKHAEEILRKRGADLLWCNARTSASGYYRKLGFSEQGEVFDTPPVGPHILMYKRIT

SEQ ID NO: 800 - DNA, 441 bp, Artificial Sequence
  Synthetic nucleic acid sequence
  CDS (1)...(441)
  D_S00398977_21-19F3
atgatagaggtaaaaccgattaacgcagaggatacctatgacctaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacatactttggtgtaatgcgcggacatccgcctcaggctactacaaaaagttaggcttcagcgagcagggagagatattcgacacgccgccagtaggacctcacatcctgatgtataaaaggatcacataa

SEQ ID NO: 801 - protein, 146 aa, Artificial Sequence
  D_S00398977_21-19F3
  Synthetic Protein Sequence
MIEVKPINAEDTYDLRHRVLRPNQPIEACMFESDLLRGAFHLGGFYGGKLISVASFHQAEHSELQGQKQYQLRGMATLEGYREQKAGSSLVKHAEEILRKRGADILWCNARTSASGYYKKLGFSEQGEIFDTPPVGPHILMYKRIT

SEQ ID NO: 802 - DNA, 441 bp, Artificial Sequence
  Synthetic nucleic acid sequence
  CDS (1)...(441)
  D_S00399101_GAT21-21A7
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcacacggaacttcaaggccagaaacagtaccagcttcgaggtatggctaccttggaaggttatcgtgagcagaaggcgggaaccagtctagttaaacacgctgaagaaattctacgtaagaggggggcggacatactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 803 - protein, 146 aa, Artificial Sequence
  D_S00399101_GAT21-21A7
  Synthetic Protein Sequence
MIEVKPINAEDTYDLRHRVLRPNQPIEACMFDSDLMRGAFHLGGFYGGKLISVASFHQAEHTELQGQKQYQLRGMATLEGYREQKAGTSLVKHAEEILRKRGADILWCNARTSASGYYRKLGFSEQGEVFDTPPVGPHILMYKRIT

SEQ ID NO: 804 - DNA, 441 bp, Artificial Sequence
  Synthetic nucleic acid sequence
  CDS (1)...(441)
  D_S00399539_21-26C1
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgttgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 805 - protein, 146 aa, Artificial Sequence
  D_S00399539_21-26C1
  Synthetic Protein Sequence
MIEVKPINAEDTYDLRHRVLRPNQPIEACMFESDLMRGAFHLGGFYGGKLISVASFHQAEHSELQGQKQYQLRGMATLEGYREQKAGSSLVKHAEEILRKRGADLLWCNARTSASGYYKKLGFSEQGEVFDTPPVGPHILMYKRIT

SEQ ID NO: 806 - DNA, 441 bp, Artificial Sequence
  Synthetic nucleic acid sequence
  CDS (1)...(441)
  D_S00399765_21-28H11
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactgatttccgtcgcttcattccaccaggccgagcactcggaacttcaaggccagaaacagtaccagattcgaggtgtggctaccttagaaggttatcgtgagcagaaggcgggaaccagtctagttaaacacgctgaagaaattctacgtaagaggggggcggacatgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 807 - protein, 146 aa, Artificial Sequence
  D_S00399765_21-28H11
  Synthetic Protein Sequence
MIEVKPINAEDTYDLRHRVLRPNQPIEACMFDSDLMRGAFHLGGFYGGKLISVASFHQAEHSELQGQKQYQIRGVATLEGYREQKAGTSLVKHAEEILRKRGADMLWCNARTSASGYYKKLGFSEQGEVFDTPPVGPHILMYKRIT

SEQ ID NO: 808 - DNA, 441 bp, Artificial Sequence
  Synthetic nucleic acid sequence
  CDS (1)...(441)
  D_S00400238_GAT22-19F1
atgatagaggtaaaaccgattaacgcagaggatacctatgaactaaggcatagagtcctcagaccaaaccagccgatagaagcgtgtatgtttgatagcgatttaatgcgtggtgcatttcacttaggcggcttctacgggggcaaactgatttccatcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggtggacctactttggtgtaatgcgcggacatccgcctcaggctactacagaaagttaggcttcagcgagcagggagagatattcgacacgccgccagtaggacctcacatcctgatgtataaaaggatcacataa

SEQ ID NO: 809 - protein, 146 aa, Artificial Sequence
  D_S00400238_GAT22-19F1
  Synthetic Protein Sequence
MIEVKPINAEDTYELRHRVLRPNQPIEACMFDSDLMRGAFHLGGFYGGKLISIASFHQAEHSELQGQKQYQLRGVATLEGYREQKAGTSLVKHAEEILRKRGVDLLWCNARTSASGYYRKLGFSEQGEIFDTPPVGPHILMYKRIT

SEQ ID NO: 810 - DNA, 441 bp, Artificial Sequence
  Synthetic nucleic acid sequence
  CDS (1)...(441)
  D_S00400319_GAT22-20D10
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggtactagtctagttaaacacgctgaagaaattctacgtaagaggggggtggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 811 - protein, 146 aa, Artificial Sequence; identical to SEQ ID NO: 753
  D_S00400319_GAT22-20D10
  Synthetic Protein Sequence

SEQ ID NO: 812 - DNA, 441 bp, Artificial Sequence
  Synthetic nucleic acid sequence
  CDS (1)...(441)
  D_S00401090_GAT22-29G1
atgatagaggtaaaaccgattaacgcagaggatacctatgacctaaggcatagagtcctcagaccaaaccagccgatagaagcgtgtatgtttgaaagcgatttactgcgtggtgcatttcacttaggcggcttctacgggggcagactgatttccgtcgcttcattccaccaggccgagcactcggaacttcaaggccagaaacagtaccagcttcgaggtatggctaccttggaaggctatcgtgagcagaaggcgggaaccagtctagttaaacacgctgaagaaattctacgtaagaggggggcggacatactttggtgcaatgcgcggacatccgcctcaggctactacaaaaagttaggcttcagcgagcagggagaggtattcgacacgccgccagtaggacctcacatcctgatgtataaaaggatcacataa

SEQ ID NO: 813 - protein, 146 aa, Artificial Sequence
  D_S00401090_GAT22-29G1
  Synthetic Protein Sequence
MIEVKPINAEDTYDLRHRVLRPNQPIEACMFESDLLRGAFHLGGFYGGRLISVASFHQAEHSELQGQKQYQLRGMATLEGYREQKAGTSLVKHAEEILRKRGADILWCNARTSASGYYKKLGFSEQGEVFDTPPVGPHILMYKRIT

SEQ ID NO: 814 - DNA, 441 bp, Artificial Sequence
  Synthetic nucleic acid sequence
  CDS (1)...(441)
  18-28D9b
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacaggggcaaactgatttccatagcttcattccaccaggccgagcactcggaactccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgcggacatccgcctcaggctactacaaaaagttaggcttcagcgagcagggagagatatttgacacgccgccagtaggacctcacatcctgatgtataaaaggatcacataa

SEQ ID NO: 815 - protein, 146 aa, Artificial Sequence; identical to SEQ ID NO: 618
  18-28D9b
  Synthetic Protein Sequence

SEQ ID NO: 816 - DNA, 441 bp, Artificial Sequence
  Synthetic nucleic acid sequence
  CDS (1)...(441)
  20-8H12c
atgatagaggtgaaaccgattaacgcagaggatacctatgaactaaggcatagagtcctcagaccaaaccagccgatagaagcgtgtatctttgaaagcgatttaatgcgtggtgcatttcacttaggcggcttctacgggggcagactgatttccgtcgcttcattccaccaggccgagcactcggaacttcaaggccagaaacagtaccagcttcgaggtatggctaccttggaaggttatcgtgagcagaaggcgggttccagtctagttaaacacgctgaagaaattctacgtaagaggggggcggacctactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 817 - protein, 146 aa, Artificial Sequence; identical to SEQ ID NO: 661
  20-8H12c
  Synthetic Protein Sequence

SEQ ID NO: 818 - DNA, 441 bp, Artificial Sequence
  Synthetic nucleic acid sequence
  CDS (1)...(441)
  20-16A3c
atgatagaggtgaaaccgattaacgcagaggatacctatgaactaaggcatagagtcctcagaccaaaccagccgatagaagcgtgtatgtttgatagcgatttactgcgtggtgcatttcacttaggcggcttctacgggggcagactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 819 - protein, 146 aa, Artificial Sequence; identical to SEQ ID NO: 641
  20-16A3c
  Synthetic Protein Sequence

SEQ ID NO: 820 - DNA, 441 bp, Artificial Sequence
  Synthetic nucleic acid sequence
  CDS (1)...(441)
  20-30C6c
atgatagaggtgaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggttccagtctagttaaacacgctgaagaaattctacgtaagaggggggcggacatactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 821 - protein, 146 aa, Artificial Sequence; identical to SEQ ID NO: 685
  20-30C6c
  Synthetic Protein Sequence

SEQ ID NO: 822 - DNA, 441 bp, Artificial Sequence
  Synthetic nucleic acid sequence
  CDS (1)...(441)
  11-3C3b
atgatagaggtgaaaccgattaacgcagaggatacctatgaactaaggcataaaatactcagaccaaaccagccgatagaagcgtgtatgtatgaaagcgatttacttcgtggtgcacttcacttaggcggctattacaggggcaaactgatttccatagcgtcattccaccaggccgagcactcagaactccaaggccagaaacagtaccagctccgaggtatggctaccttggaaggttatcgtgagcagaaagcgggatcgagtctaattaaacacgctgaagaaattcttcgtaagaggggggcggacttgctttggtgcaatgcgcggacatccgcctcaggctactacaaaaagttaggcttcagcgagcagggagaggtatttgacacgccgccagtaggacctcacatcctgatgtataaaaggatcacataa

SEQ ID NO: 823 - protein, 146 aa, Artificial Sequence; identical to SEQ ID NO: 462
  11-3C3b
  Synthetic Protein Sequence

SEQ ID NO: 824 - DNA, 441 bp, Artificial Sequence
  Synthetic nucleic acid sequence
  CDS (1)...(441)
  18-28D9c
atgatagaggtgaaaccgattaacgcagaggatacctatgaactaaggcatagaatactcagaccaaaccagccgatagaagcgtgtatgtttgaaagcgatttacttcgtggtgcatttcacttaggcggcttttacaggggcaaactgatttccatagcttcattccaccaggccgagcactcggaactccaaggccagaaacagtaccagctccgaggtatggctaccttggaaggttatcgtgagcagaaagcgggatcaactctagttaaacacgctgaagaaatccttcgtaagaggggggcggacatgctttggtgtaatgcgaggacatccgcctcaggctactacaaaaagttaggcttcagcgagcagggagagatatttgacacgccgccagtaggacctcacatcctgatgtataaaaggatcacataa

SEQ ID NO: 825 - protein, 146 aa, Artificial Sequence; identical to SEQ ID NO: 618
  18-28D9c
  Synthetic Protein Sequence

SEQ ID NO: 826 - DNA, 15 bp, Artificial Sequence
  Synthetic nucleic acid sequence
atgattgaagtcaaa

SEQ ID NO: 827 - DNA, 15 bp, Artificial Sequence
  Synthetic nucleic acid sequence
agtatcgaggtgaag

SEQ ID NO: 828 - protein, 5 aa, Artificial Sequence
  Synthetic Protein Sequence
MIEVK

SEQ ID NO: 829 - protein, 10 aa, Artificial Sequence
  Synthetic Protein Sequence
RPNQPLEACM

SEQ ID NO: 830 - protein, 10 aa, Artificial Sequence
  Synthetic Protein Sequence
KPQQPVESCM

SEQ ID NO: 831 - protein, 10 aa, Artificial Sequence
  Synthetic Protein Sequence
KPNNPLDACV

SEQ ID NO: 832 - DNA, 441 bp, Artificial Sequence
  Synthetic nucleic acid sequence
  CDS (1)...(441): GAT23-1F7
atgatagaggtaaaaccgattaacgcagaagatacctatgacctaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcacacggaacttcaaggccagaaacagtatcagcttcgaggtgtggctaccttggagggttatcgtgagcagaaggcgggttccagcctagttaaacgcgctgaagaaattctacgtaagaggggggcggacatgctttggtgcaatgcgcggacatcggcctcaggctactacagaaagttaggcttcagcgagcagggagaggtattcgacacgccgccagtaggacctcacatcctgatgtataaaaggatcacataa

SEQ ID NO: 833 - protein, 146 aa, Artificial Sequence
  23-1F7
MIEVKPINAEDTYDLRHRVLRPNQPIEACMFESDLTRGAFHLGGFYGGKLISVASFHQAEHTELQGQKQYQLRGVATLEGYREQKAGSSLVKRAEEILRKRGADMLWCNARTSASGYYRKLGFSEQGEVFDTPPVGPHILMYKRIT

SEQ ID NO: 834 - DNA, 441 bp, Artificial Sequence
  Synthetic nucleic acid sequence
  CDS (1)...(441): GAT23-2H1
atgatagaggtaaaaccgattaacgcagaggatacctatgacctaaggcatagagtcctcagaccaaaccagccgatagaagcgtgtatgtttgatagcgatttaacgcgtggtgcatttcacttaggcggcttctacgggggcaaactgatttccgtcgcttcattccaccaggccgagcactcggaacttcagggccagaaacagtaccagcttcgaggtgtggctaccttggagggttatcgtgagcagaaggcgggttccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggaccccacatcctgatgtataaaaggatcacataa

SEQ ID NO: 835 - protein, 146 aa, Artificial Sequence
  23-2H1
MIEVKPINAEDTYDLRHRVLRPNQPIEACMFDSDLTRGAFHLGGFYGGKLISVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 836 - DNA, 441 bp, Artificial Sequence
  Synthetic nucleic acid sequence
  CDS (1)...(441): GAT23-2H11
atgatagaggtaaaaccgattaacgcagaggatacctatgacctaaggcatagagtcctcagaccaaaccagccgatagaagcgtgtatgtttgaaggcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggttccagtctagttaaacatgctgaagaaattctacgcaagaggggggcggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 837 - protein, 146 aa, Artificial Sequence
  23-2H11
MIEVKPINAEDTYDLRHRVLRPNQPIEACMFEGDLMRGAFHLGGFYGGKLISVASFHQAEHSELQGQKQYQLRGVATLEGYREQKAGSSLVKHAEEILRKRGADLLWCNARTSASGYYRKLGFSEQGEVFDTPPVGPHILMYKRIT

SEQ ID NO: 838 - DNA, 441 bp, Artificial Sequence
  Synthetic nucleic acid sequence
  CDS (1)...(441): GAT23-3H1
atgatagaggtaaaaccgattaacgcagaggatacctatgacctaaggcatagagtcctcagaccaaaccagccgatagaagcgtgtatgtttgaaagcgatttaacgcgtggtgcatttcacctaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 839 - protein, 146 aa, Artificial Sequence
  23-3H1
MIEVKPINAEDTYDLRHRVLRPNQPIEACMFESDLTRGAFHLGGFYGGKLISVASFHQAEHSELQGQKQYQLRGVATLEGYREQKAGTSLVKHAEEILRKRGADMLWCNARTSASGYYRKLGFSEQGEVFDTPPVGPHILMYKRIT

SEQ ID NO: 840 - DNA, 441 bp, Artificial Sequence
  Synthetic nucleic acid sequence
  CDS (1)...(441): GAT23-5A3
atgatagaggtaaaaccgattaacgcagaggatacctatgacctaaggcatagagtcctcagaccaaaccagccgatagaagcgtgtatgtttgatagtgatttaacgcgtggtgcatttcacttaggcggcttctacgggggcaaactgatttccgtcgcttcattccaccaggccgagcactcggaacttcaaggccagaaacagtatcagcttcgaggcgtggctaccttggaaggttatcgtgagcagaaggcgggttccagtctagttaaacacgctgaagaaattctacgtaagaggggggtggacctactttggtgtaatgcgcggacatccgcctcgggctactacagaaagttaggcttcagcgagcagggagaggtattcgacacgccgccagtaggacctcacatcctgatgtataaaaggatcacataa

SEQ ID NO: 841 - protein, 146 aa, Artificial Sequence
  23-5A3
MIEVKPINAEDTYDLRHRVLRPNQPIEACMFDSDLTRGAFHLGGFYGGKLISVASFHQAEHSELQGQKQYQLRGVATLEGYREQKAGSSLVKHAEEILRKRGVDLLWCNARTSASGYYRKLGFSEQGEVFDTPPVGPHILMYKRIT

SEQ ID NO: 842 - DNA, 441 bp, Artificial Sequence
  Synthetic nucleic acid sequence
  CDS (1)...(441): GAT23-6A3
atgatagaggtaaaaccgattaacgcagaggatacctatgacctaaggcatagagtcctcagaccgaaccagccgatagaagcgtgtatgtttgaaagcgatttaatgcgtggtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggttccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 843 - protein, 146 aa, Artificial Sequence
  23-6A3
MIEVKPINAEDTYDLRHRVLRPNQPIEACMFESDLMRGAFHLGGFYGGKLISVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 844 - DNA, 441 bp, Artificial Sequence
  Synthetic nucleic acid sequence
  CDS (1)...(441): GAT23-6H10
atgatagaggtaaaaccgattaacgcagaggatacctatgaactaaggcatagagtcctcagaccaaaccagccgatagaagcgtgtatgtttgaaagcgatttaacgcgtggtgcatttcacctaggcggcttctacgggggcaaactgatttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggcggacctactttggtgtaatgcgcggacatccgcctcaggctactacagaaagttaggcttcagcgagcagggggaggtattcgacacgccgccagtaggacctcacatcctgatgtataaaaggatcacataa

SEQ ID NO: 845 - protein, 146 aa, Artificial Sequence
  23-6H10
MIEVKPINAEDTYELRHRVLRPNQPIEACMFESDLTRGAFHLGGFYGGKLISVASFHQAEHTELQGQKQYQLRGVATLEGYREQKAGSSLVKHAEEILRKRGADLLWCNARTSASGYYRKLGFSEQGEVFDTPPVGPHILMYKRIT

SEQ ID NO: 846 - DNA, 441 bp, Artificial Sequence
  Synthetic nucleic acid sequence
  CDS (1)...(441): GAT24-4D5
atgatagaggtaaaaccgattaacgcagaggatacctatgaactaaggcatagagtcctcagaccaaaccagccgatagaagcgtgtatgtttgatagcgatttaacgcgtggtgcgtttcacttaggcggcttctacgggggcaaactgatttccgtcgcttcattccaccgggccgagcacacggaacttcaaggccagaaacagtatcagcttcgaggtgtggctaccttggaaggttatcgtgagcagaaggcgggttccagtctagttaaacacgctgaagaaattctacgtaagaggggggcggacctactttggtgtaatgcgcggacatccgcctcaggctactacagaaagctaggcttcagcgagcagggagaggtattcgacacgccgccagtaggacctcacatcctgatgtataaaaggatcacataa

SEQ ID NO: 847 - protein, 146 aa, Artificial Sequence
  24-4D5
MIEVKPINAEDTYELRHRVLRPNQPIEACMFDSDLTRGAFHLGGFYGGKLISVASFHRAEHTELQGQKQYQLRGVATLEGYREQKAGSSLVKHAEEILRKRGADLLWCNARTSASGYYRKLGFSEQGEVFDTPPVGPHILMYKRIT

SEQ ID NO: 848 - DNA, 441 bp, Artificial Sequence
  Synthetic nucleic acid sequence
  CDS (1)...(441): GAT24-5H5
atgatagaggtaaaaccgattaacgcagaagatacctatgacctaaggcatagagtcctcagaccaaaccagccgatagaagcgtgtatgtttgataacgatttaatgcgtagtgcatttcacttaggcggcttccacgggggcaaactgatttccgtcgcttcattccaccaggccgagcactcggaacttcaaggccagaaacagtatcagcttcgaggtgtggctaccttggaaggttatcgtgagcagaaggcgggttccagtctagttaaacacgctgaagaaattctacgtaagaggggggcggacatgctttggtgtaatgcgcggacatccgcctcaggctactacagaaagttgggcttcagcgagcagggagaggtattcgacacgccgccggtaggacctcacatcctgatgtataaaaggatcacataa

SEQ ID NO: 849 - protein, 146 aa, Artificial Sequence
  24-5H5
MIEVKPINAEDTYDLRHRVLRPNQPIEACMFDNDLMRSAFHLGGFHGGKLISVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 850 - DNA, 441 bp, Artificial Sequence
  Synthetic nucleic acid sequence
  CDS (1)...(441): GAT23-13D7
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctacgggggcaaactgatttccgtcgcttcattccacagggccgagcacacggaacttcaaggccagaaacagtaccagcttcgaggtgtggctaccttggaaggttatcgtgagcagaaggcgggtactagtctagttaaacacgctgaagaaattctacgtaagaggggggtggacctactttggtgtaatgcgcggacatccgcctcaggctactacaaaaagctaggcttcagcgagcagggagaggtattcgacacgccgccagtaggacctcacatcctgatgtataaaaggatcacataa

SEQ ID NO: 851 - protein, 146 aa, Artificial Sequence
  23-13D7
MIEVKPINAEDTYELRHRVLRPNQPIEACMFESDLTRGAFHLGGFYGGKLISVASFHRAEHTELQGQKQYQLRGVATLEGYREQKAGTSLVKHAEEILRKRGVDLLWCNARTSASGYYKKLGFSEQGEVFDTPPVGPHILMYKRIT

SEQ ID NO: 852 - DNA, 441 bp, Artificial Sequence
  Synthetic nucleic acid sequence
  CDS (1)...(441): GAT24-9G5
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggttccagtctagttaaatacgctgaagaaattctacgtaagaggggggtggacctgctttggtgtaatgcgcggacatccgcctcaggctactacagaaagttaggcttcagcgagcagggagaggtattcgacacgccgccagtgggaccccacatcctgatgtataaaaggatcacataa

SEQ ID NO: 853 - protein, 146 aa, Artificial Sequence
  24-9G5
MIEVKPINAEDTYELRHRVLRPNQPIEACMFESDLTRGAFHLGGFYGGKLISVASFHQAEHSELQGQKQYQLRGVATLEGYREQKAGSSLVKYAEEILRKRGVDLLWCNARTSASGYYRKLGFSEQGEVFDTPPVGPHILMYKRIT

SEQ ID NO: 854 - DNA, 441 bp, Artificial Sequence
  Synthetic nucleic acid sequence
  CDS (1)...(441): GAT24-9H9
atgatagaggtaaaaccgattaacgcagaggatacctatgacctaaggcatagagtcctcagaccaaaccagccgatagaagcgtgtatgtttgatagcgatttaacgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggttccagtctagttaaacacgctgaagaaattctacgtaagaggggggcggacatactttggtgtaatgcgcggacatcggcctcaggctactacaaaaagttaggcttcagcgagcagggagaggtattcgacacgcctccagtaggacctcacatcctgatgtataaaaggatcacataa

SEQ ID NO: 855 - protein, 146 aa, Artificial Sequence
  24-9H9
MIEVKPINAEDTYDLRHRVLRPNQPIEACMFDSDLTRGAFHLGGFYGGKLISVASFHQAEHSELQGQKQYQLRGVATLEGYREQKAGSSLVKHAEEILRKRGADILWCNARTSASGYYKKLGFSEQGEVFDTPPVGPHILMYKRIT

SEQ ID NO: 856 - DNA, 441 bp, Artificial Sequence
  Synthetic nucleic acid sequence
  CDS (1)...(441): GAT24-12A5
atgatagatgtaaaaccgattaacgcagaggatacctatgaactaaggcatagagtcctcagaccaaaccagccgatagaagcgtgtatgtttgatagcgatttaacgcgtggtgcatttcacttaggcggcttctacgggggcaaactgatttccgtcgcttcattccaccaggccgagcactcggaacttcaaggccagaaacagtatcagcttcgaggtgtggctaccttggaaggttatcgtgagcagaaggcgggttccagtctagttaaacacgccgaagaaattctacgtaagaggggggcggacctactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 857 - protein, 146 aa, Artificial Sequence
  24-12A5
MIDVKPINAEDTYELRHRVLRPNQPIEACMFDSDLTRGAFHLGGFYGGKLISVASFHQAEHSELQGQKQYQLRGVATLEGYREQKAGSSLVKHAEEILRKRGADLLWCNARTSASGYYKKLGFSEQGEVFDTPPVGPHILMYKRIT

SEQ ID NO: 858 - DNA, 441 bp, Artificial Sequence
  Synthetic nucleic acid sequence
  CDS (1)...(441): GAT24-14B7
atgatagaggtaaaaccgattaacgcagaggatacctatgaactaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggttccagtctagtcaaacacgctgaagaaattctacgcaagaggggggcggacatgatttggtgtaatgcgcggacatcagcctcaggctactacagaaagttaggcttcagcgagcagggagaggtattcgacacgccgccagtaggacctcacatcctgatgtataaaaggatcacataa

SEQ ID NO: 859 - protein, 146 aa, Artificial Sequence
  24-14B7
MIEVKPINAEDTYELRHRVLRPNQPIEACMFESDLMRGAFHLGGFYGGKLISVASFHQAEHSELQGQKQYQLRGVATLEGYREQKAGSSLVKHAEEILRKRGADMIWCNARTSASGYYRKLGFSEQGEVFDTPPVGPHILMYKRIT

SEQ ID NO: 860 - DNA, 441 bp, Artificial Sequence
  Synthetic nucleic acid sequence
  CDS (1)...(441): GAT24-15B10
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 861 - protein, 146 aa, Artificial Sequence
  24-15B10
MIEVKPINAEDTYELRHRVLRPNQPIEACMFESDLTRGAFHLGGFYGGKLISVASFHQAEHSELQGQKQYQLRGVATLEGYREQKAGTSLVKHAEEILRKRGADMLWCNARTSASGYYKKLGFSEQGEVFDTPPVGPHILMYKRIT

SEQ ID NO: 862 - DNA, 441 bp, Artificial Sequence
  Synthetic nucleic acid sequence
  CDS (1)...(441): GAT24-15C3
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggaaccagtctagttaaacacgctgaagaaattctacgtaagaggggggcggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 863 - protein, 146 aa, Artificial Sequence
  24-15C3
MIEVKPINAEDTYDLRHRVLRPNQPIEACMFESDLTRSAFHLGGFYGGKLISVASFHQAEHSELQGQKQYQLRGVATLEGYREQKAGTSLVKHAEEILRKRGADLLWCNARTSASGYYRKLGFSEQGEVFDTPPVGPHILMYKRIT

SEQ ID NO: 864 - DNA, 441 bp, Artificial Sequence
  Synthetic nucleic acid sequence
  CDS (1)...(441): GAT24-16B1
atgatagaggtaaaaccgattaacgcagaggatacctatgacctaaggcatagagtcctcagaccaaaccagccggtagaagcgtgtatgtttgaaagcgatttaacgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacctactttggtgtaatgcgcggacatccgcctcaggctactacagaaagttaggcttcagcgagcagggagaggtattcgacacgccgccagtgggacctcacatcctgatgtataaaaggatcacataa

SEQ ID NO: 865 - protein, 146 aa, Artificial Sequence
  24-16B1
MIEVKPINAEDTYDLRHRVLRPNQPVEACMFESDLTRGAFHLGGFYGGKLISVASFHQAEHSELQGQKQYQLRGVATLEGYREQKAGTSLVKHAEEILRKRGADLLWCNARTSASGYYRKLGFSEQGEVFDTPPVGPHILMYKRIT

SEQ ID NO: 866 - DNA, 441 bp, Artificial Sequence
  Synthetic nucleic acid sequence
  CDS (1)...(441): GAT24-16H12
atgatagaggtaaaaccgattaacgcagaggatacctatgacctaaggcatagagtcctcagaccaaaccagccgatagaagcgtgtatgtttgatagcgatttaatgcgtggtgcatttcacttaggcggcttctacgggggcaaactggtttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 867 - protein, 146 aa, Artificial Sequence
  24-16H12
MIEVKPINAEDTYDLRHRVLRPNQPIEACMFDSDLMRGAFHLGGFYGGKLVSVASFHQAEHTELQGQKQYQLRGVATLEGYREQKAGSSLVKHAEEILRKRGADMLWCNARTSASGYYRKLGFSEQGEVFDTPPVGPHILMYKRIT

SEQ ID NO: 868 - DNA, 441 bp, Artificial Sequence
  Synthetic nucleic acid sequence
  CDS (1)...(441): GAT24-17A10
atgatagaggtaaaaccgattaacgcagaggatacctatgaactaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttaccgtgagcagaaggcgggaaccagtctagttaaacacgctgaagaaattctacgtaagaggggggcggacctgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 869 - protein, 146 aa, Artificial Sequence
  24-17A10
MIEVKPINAEDTYELRHRVLRPNQPIEACMFESDLMRGAFHLGGFYGGKLISVASFHQAEHSELQGQKQYQLRGVATLEGYREQKAGTSLVKHAEEILRKRGADLLWCNARTSASGYYRKLGFSEQGEVFDTPPVGPHILMYKRIT

SEQ ID NO: 870 - DNA, 441 bp, Artificial Sequence
  Synthetic nucleic acid sequence
  CDS (1)...(441): GAT24-17G11
atgatagaggtaaaaccgattaacgcagaggatacttatgaactaaggcatagagtcctcagaccaaaccagccgatagaagcgtgtatgtttgatagcgatttaatgcgtggtgcatttcacttaggcggcttctacgggggcaaactggtttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggcggacatactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 871 - protein, 146 aa, Artificial Sequence
  24-17G11
MIEVKPINAEDTYELRHRVLRPNQPIEACMFDSDLMRGAFHLGGFYGGKLVSVASFHQAEHSELQGQKQYQLRGVATLEGYREQKAGTSLVKHAEEILRKRGADILWCNARTSASGYYRKLGFSEQGEVFDTPPVGPHILMYKRIT

SEQ ID NO: 872 - DNA, 441 bp, Artificial Sequence
  Synthetic nucleic acid sequence
  CDS (1)...(441): GAT24-19H3
atgatagaggtaaaaccgattaacgcagaagatacctatgacctaaggcatagagtcctcagaccaaaccagccgatagaagcgtgtatgtttgaaagcgatttactgcgtggtgcatttcacttaggcggcttctacgggggcaaactgatttccgtcgcttcattccaccaggctgagcacacggaacttcaaggccagaaacagtaccagcttcgaggtgtggctaccttggaaggttatcgtgagcagaaggcgggttccagtctagttaaacacgctgaagaaattctacgtaagaggggggcggacctactttggtgtaatgcgcggacatccgcctcaggctactacagaaagttaggctttagcgagcagggagaggtattcgacacgccgccagtaggacctcacatcctgatgtataaaaggatcacataa

SEQ ID NO: 873 - protein, 146 aa, Artificial Sequence
  24-19H3
MIEVKPINAEDTYDLRHRVLRPNQPIEACMFESDLLRGAFHLGGFYGGKLISVASFHQAEHTELQGQKQYQLRGVATLEGYREQKAGSSLVKHAEEILRKRGADLLWCNARTSASGYYRKLGFSEQGEVFDTPPVGPHILMYKRIT

SEQ ID NO: 874 - DNA, 441 bp, Artificial Sequence
  Synthetic nucleic acid sequence
  CDS (1)...(441): GAT23-14A3
atgatagaggtaaaaccgattaacgcagaggatacctatgacctaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcacacggaacttcagggccagaaacagtaccagcttcgaggtgtggctaccttggaaggttatcgtgagcagaaggcgggaaccagtctagttaaacacgctgaagaaattctacgtaagaggggggcggacctactttggtgtaatgcgcggacatccgcctcaggctactacaaaaagttaggcttcagcgagcagggagaggtattcgacacgccgccagtaggacctcacatcctgatgtataaaaggatcacataa

SEQ ID NO: 875 - protein, 146 aa, Artificial Sequence
  23-14A3
MIEVKPINAEDTYDLRHRVLRPNQPIEACMFESDLMRGAFHLGGFYGGKLISVASFHQAEHTELQGQKQYQLRGVATLEGYREQKAGTSLVKHAEEILRKRGADLLWCNARTSASGYYKKLGFSEQGEVFDTPPVGPHILMYKRIT

SEQ ID NO: 876 - DNA, 441 bp, Artificial Sequence
  Synthetic nucleic acid sequence
  CDS (1)...(441): GAT23-14B4
atgatagaggtaaaaccgattaacgcagaagatacctatgacctaaggcatagagtcctcagaccaaaccagccgatagaagcgtgtatgtttgaaagcgatttaacgcgtggtgcatttcacttaggcggcttctacgggggcaaactgatttccgtcgcttcattccaccgggccgagcactcggaacttcaaggccagaaacagtaccagcttcgaggtgtggctaccttggaaggttatcgtgagcagaaggcgggttccagtctggttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 877 - protein, 146 aa, Artificial Sequence
  23-14B4
MIEVKPINAEDTYDLRHRVLRPNQPIEACMFESDLTRGAFHLGGFYGGKLISVASFHRAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 878 - DNA, 441 bp, Artificial Sequence
  Synthetic nucleic acid sequence
  CDS (1)...(441): GAT23-15G3
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggaaccagtctagttaaacacgctgaagaaattctacgtaagaggggggtggacctactttggtgtaatgcgcggacatccgcctcaggctactacagaaagttaggcttcagcgagcagggagaggtattcgacacgccgccagtaggacctcacgtcctgatgtataaaaggatcacataa

SEQ ID NO: 879 - protein, 146 aa, Artificial Sequence
  23-15G3
MIEVKPINAEDTYELRHRVLRPNQPIEACMFESDLTRGAFHLGGFYGGKLISVASFHQAEHSELQGQKQYQLRGVATLEGYREQKAGTSLVKHAEEILRKRGVDLLWCNARTSASGYYRKLGFSEQGEVFDTPPVGPHVLMYKRIT

SEQ ID NO: 880 - DNA, 441 bp, Artificial Sequence
  Synthetic nucleic acid sequence
  CDS (1)...(441): GAT23-18G4
atgatagaggtaaaaccgattaacgcagaggatacctatgaactaaggcatagagtcctcagaccaaaccagccgatagaagcgtgtatgtttgaaagcgatttaatgcgtggtgcatttcacttaggcggcttctacgggggcaaactgatttccgtcgcttcattccaccaggccgagcgctcggaacttcagggccagaaacagtaccagcttcgaggtatggctaccttggaaggttatcgtgagcagaaggcgggttccagtctagttaaacacgctgaagaaattctacgtaagaggggggcggacatgctttggtgtaatgcgcggacatccgcctcaggctactacagaaagttaggcttcagcgagcagggagaggtattcgacacgccgccagcaggacctcacatcctgatgtataaaaggatcacataa

SEQ ID NO: 881 - protein, 146 aa, Artificial Sequence
  23-18G4
MIEVKPINAEDTYELRHRVLRPNQPIEACMFESDLMRGAFHLGGFYGGKLISVASFHQAERSELQGQKQYQLRGMATLEGYREQKAGSSLVKHAEEILRKRGADMLWCNARTSASGYYRKLGFSEQGEVFDTPPAGPHILMYKRIT

SEQ ID NO: 882 - DNA, 441 bp, Artificial Sequence
  Synthetic nucleic acid sequence
  CDS (1)...(441): GAT23-18H5
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcactcggaacttcaaggccagaaacagtatcagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 883 - protein, 146 aa, Artificial Sequence
  23-18H5
MIEVKPINAEDTYELRHRVLRPNQPIEACMFESDLTRGAFHLGGFYGGKLISVASFHQAEHSELQGQKQYQLRGVATLEGYREQKAGTSLVKHAEEILRKRGADMLWCNARTSASGYYRKLGFSEQGEVFDTPPVGPHILMYKRIT

SEQ ID NO: 884 - DNA, 441 bp, Artificial Sequence
  Synthetic nucleic acid sequence
  CDS (1)...(441): GAT23-19C3
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctatgggggcaaactgatctccgtcgcttcattccaccaggccgggcacacggaacttcaaggccagaaacagtaccagcttcgaggtgtggctaccttggaaggttatcgtgagcagaaggcgggttccagtctagttaaacacgctgaagaaattctacgtaagaggggggcggacatactttggtgtaatgcgcggacatcggcctcaggctactacagaaagttaggcttcagcgagcagggagaggtattcgacacgccgccagtaggacctcacatcctgatgtataaaaggatcacataa

SEQ ID NO: 885 - protein, 146 aa, Artificial Sequence
  23-19C3
MIEVKPINAEDTYELRHRVLRPNQPIEACMFESDLTRGAFHLGGFYGGKLISVASFHQAGHTELQGQKQYQLRGVATLEGYREQKAGSSLVKHAEEILRKRGADILWCNARTSASGYYRKLGFSEQGEVFDTPPVGPHILMYKRIT

SEQ ID NO: 886 - DNA, 441 bp, Artificial Sequence
  Synthetic nucleic acid sequence
  CDS (1)...(441): GAT23-19F6
atgatagaggtaaaaccgattaacgcagaagatacctatgacctaaggcatagagtcctcagaccaaaccagccgatagaagcgtgtatgtttgatagcgatttaacgcgtagtgcatttcacttaggcggcttctacgggggcaaactgatttccgtcgcttcattccaccaggccgagcacacggaacttcaaggccggaaacagtaccagcttcgaggtgtggctaccttggaaggttatcgtgagcagaaggcgggaaccagtctagttaaacacgctgaagaaattctacgtaagaggggggtggacctactttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 887 - protein, 146 aa, Artificial Sequence
  23-19F6
MIEVKPINAEDTYDLRHRVLRPNQPIEACMFDSDLTRSAFHLGGFYGGKLISVASFHQAEHTELQGRKQYQLRGVATLEGYREQKAGTSLVKHAEEILRKRGVDLLWCNARTSASGYYRKLGFSEQGEVFDTPPVGPHILMYKRIT

SEQ ID NO: 888 - DNA, 441 bp, Artificial Sequence
  Synthetic nucleic acid sequence
  CDS (1)...(441): GAT25-1D10
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggaaccagtctagttaaacacgctgaagaaattctacgtaagaggggggcggacctactttggtgtaatgcgcggacatccgcctcaggctactacaaaaagctaggcttcagcgagcagggagaggtattcgacacgccgccagtaggacctcacatcctgatgtataaaaggatcacataa

SEQ ID NO: 889 - protein, 146 aa, Artificial Sequence
  25-1D10
MIEVKPINAEDTYDLRHRVLRPNQPIEACMFESDLTRSAFHLGGFYGGKLISVASFHQAEHSELQGQKQYQLRGVATLEGYREQKAGTSLVKHAEEILRKRGADLLWCNARTSASGYYKKLGFSEQGEVFDTPPVGPHILMYKRIT

SEQ ID NO: 890 - DNA, 441 bp, Artificial Sequence
  Synthetic nucleic acid sequence
  CDS (1)...(441): GAT26-2D9
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccggtaggacctcacatcctgatgtacaaaaggatcacataa

SEQ ID NO: 891 - protein, 146 aa, Artificial Sequence
  26-2D9
MIEVKPINAEDTYDLRHRVLRPNQPIEACMFESDLTRSAFHLGGFYGGKLISVASFHQAEHSELQGQKQYQLRGVATLEGYREQKAGTSLVKHAEEILRKRGADMLWCNARTSASGYYRKLGFSEQGEVFDTPPVGPHILMYKRIT

SEQ ID NO: 892 - DNA, 441 bp, Artificial Sequence
  Synthetic nucleic acid sequence
  CDS (1)...(441): GAT26-2H4
atgatagaggtaaaaccgattaacgcagaggatacctatgacctaaggcatagagtcctcagaccaaaccagccgatagaagcgtgtatgtttgataacgatttaacgcgtggtgcgtttcacttaggcggcttctacgggggcaaactgatctccgtcgcttcattccaccaggccgagcactcggaacttcaaggccagaaacagtaccagcttcgaggtgtggctaccttggaaggttaccgtgagcagaaggcgggtactagtctagtcaaacacgctgaagaaattctacgtaagaggggggcggacatgctttggtgtaatgcgcggacatccgcctcaggctactacaaaaagctaggcttcagcgagcagggagaggtattcgacacgccgccagtaggacctcacatcctgatgtataaaaggatcacataa

SEQ ID NO: 893 - protein, 146 aa, Artificial Sequence
  26-2H4
MIEVKPINAEDTYDLRHRVLRPNQPIEACMFDNDLTRGAFHLGGFYGGKLISVASFHQAEHSELQGQKQYQLRGVATLEGYREQKAGTSLVKHAEEILRKRGADMLWCNARTSASGYYKKLGFSEQGEVFDTPPVGPHILMYKRIT

SEQ ID NO: 894 - DNA, 441 bp, Artificial Sequence
  Synthetic nucleic acid sequence
  CDS (1)...(441): GAT26-3B5
atgatagaggtaaaaccgattaacgcagaagatacctatgacctaaggcacagagtcctcagaccaaaccagccgatagaagcgtgtatgtttgaaagcgatttaacgcgtggtgcatttcacttaggcggcttctatgggggcaaactgatctccgtcgcttcattccaccaggctgagcacacggaacttcaaggccagaaacagtaccagcttcgaggtgtggctaccttggaaggttatcgtgagcagaaggcgggttccagtctagtcaaacacgctgaagaaattctacgtaagaggggggtggacctactttggtgtaatgcgcggacatccgcctcaggctactacagaaagttgggcttcagcgagcagggagaggtattcgacacgccgccagtaggacctcacatcctgatgtataaaaggatcacataa

SEQ ID NO: 895 - protein, 146 aa, Artificial Sequence
  26-3B5
MIEVKPINAEDTYDLRHRVLRPNQPIEACMFESDLTRGAFHLGGFYGGKLISVASFHQAEHTELQGQKQYQLRGVATLEGYREQKAGSSLVKHAEEILRKRGVDLLWCNARTSASGYYRKLGFSEQGEVFDTPPVGPHILMYKRIT

SEQ ID NO: 896 - DNA, 441 bp, Artificial Sequence
  Synthetic nucleic acid sequence
  CDS (1)...(441): GAT26-8F11
atgatagaggtaaaaccgattaacgcagaagatacctatgaactaaggcatagagtcctcagaccaaaccagccgatagaagcgtgtatgtttgataacgatttaacgcgtggcgcatttcacttaggcggcttctacgggggcaaactgatttccgtcgcttcattccaccaggccgggcactcggaacttcagggccagaaacagtaccagcttcgaggtgtggctaccttggaaggttatcgtgagcagaaggcgggaaccagtctagtcaaacacgctgaagaaattctacgtaagaggggggcggacatgctttggtgtaatgcgcggacatccgcctcaggctactacagaaagttgggcttcagcgagcagggagaggtattcgacacgccgccagtaggacctcacatcctgatgtataaaaggatcacataa

SEQ ID NO: 897 - protein, 146 aa, Artificial Sequence
  26-8F11
MIEVKPINAEDTYELRHRVLRPNQPIEACMFDNDLTRGAFHLGGFYGGKLISVASFHQAGHSELQGQKQYQLRGVATLEGYREQKAGTSLVKHAEEILRKRGADMLWCNARTSASGYYRKLGFSEQGEVFDTPPVGPHILMYKRIT

SEQ ID NO: 898 - DNA, 441 bp, Artificial Sequence
  Synthetic nucleic acid sequence
  CDS (1)...(441): GAT26-9G5
atgatagaggtaaaaccgattaacgcagaagatacctatgacctaaggcatagagtcctcagaccaaaccagccgatagcagcgtgtatgtttgaaagcgatttaacgcgtggtgcatttcacttaggcggcttctacgggggcaaactggtttccgtcgcttcgttccaccaggccgagcactcggaacttcaaggccagaaacagtaccagcttcgaggtgtggctaccttggaaggttatcgtgagcagaaggcgggttccagtctagttaaacacgctgaagaaattctacgtaagaggggggcggacctactttggtgtaatgcgcggacatccgcctcaggctactacagaaagttgggcttcagcgagcagggagaggtattcgacacgccgccagtaggacctcacatcctgatgtataaaaggatcacataa

SEQ ID NO: 899 - protein, 146 aa, Artificial Sequence
  26-9G5
MIEVKPINAEDTYDLRHRVLRPNQPIAACMFESDLTRGAFHLGGFYGGKLVSVASFHQAEHSELQGQKQYQLRGVATLEGYREQKAGSSLVKHAEEILRKRGADLLWCNARTSASGYYRKLGFSEQGEVFDTPPVGPHILMYKRIT

SEQ ID NO: 900 - DNA, 441 bp, Artificial Sequence
  Synthetic nucleic acid sequence
  CDS (1)...(441): GAT26-15D10
atgatagaggtgaaaccgattaacgcagaggatacctacgaactaagacatagagtcctcagaccaaaccagccgatagaagcgtgtatgtttgatagcgatttaacgcgtagtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggttccagtctagttaaacacgctgaagaaattctacgtaagaggggggcggacatgctttggtgtaatgcgcggacatccgcctcaggctactacagaaagttgggctttagcgagcagggagaggtattcgacacgccgccagtaggacctcacatcctgatgtataaaaggatcacataa

SEQ ID NO: 901 - protein, 146 aa, Artificial Sequence
  26-15D10
MIEVKPINAEDTYELRHRVLRPNQPIEACMFDSDLTRSAFHLGGFYGGKLISVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 902 - DNA, 441 bp, Artificial Sequence
  Synthetic nucleic acid sequence
  CDS (1)...(441): GAT26-20H11
atgatagaggtaaaaccgattaacgcagaggatacctatgacctaaggcatagagtcctcagaccaaaccagccgatagaagcgtgtatgtttgatagcgatttaacgcgtagtgcatttcacttaggcggcttctacgggggcaaactgatttccgtcgcttcattccaccaggccgagcactcggaacttcagggccagaaacagtatcagcttcgaggtgtggctaccttggaaggttatcgcgagcagaaggcgggaaccagtctagttaaacacgctgaagaaattctacgtaagaggggggcggacctactttggtgtaatgcgcggacatccgcctcaggctactacaggaagttaggcttcagcgagcagggagaggtattcgacacgccgccagtaggacctcacatcctgatgtataaaaggatcacataa

SEQ ID NO: 903 - protein, 146 aa, Artificial Sequence
  26-20H11
MIEVKPINAEDTYDLRHRVLRPNQPIEACMFDSDLTRSAFHLGGFYGGKLISVASFHQAEHSELQGQKQYQLRGVATLEGYREQKAGTSLVKHAEEILRKRGADLLWCNARTSASGYYRKLGFSEQGEVFDTPPVGPHILMYKRIT

SEQ ID NO: 904 - DNA, 441 bp, Artificial Sequence
  Synthetic nucleic acid sequence
  CDS (1)...(441): GAT26-20H12
atgatagaggtaaaaccgattaacgcagaggatacctatgacctaaggcatagagtcctcagaccaaaccagccgatagaagcgtgtatgtttgaaggcgacttaacgcgtggtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggttccagtctagtcaaacacgctgaagaaatcctacgtaagaggggggcggacatgctttggtgtaatgcgcggacatcagcctcaggctactacagaaagttaggcttcagcgagcagggggaggtattcgacacgccgccggtgggacctcacatcctgatgtataaaaggatcacataa

SEQ ID NO: 905 - protein, 146 aa, Artificial Sequence
  26-20H12
MIEVKPINAEDTYDLRHRVLRPNQPIEACMFEGDLTRGAFHLGGFYGGKLISVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 906 - DNA, 441 bp, Artificial Sequence
  Synthetic nucleic acid sequence
  CDS (1)...(441): GAT25-8H7
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 907 - protein, 146 aa, Artificial Sequence
  25-8H7
MIEVKPINAEDTYDLRHRVLRPNQPIEACMFESDLTRSAFHLGGFYGGKLISVASFHQAEHSELQGKKQYQLRGVATLEGYREQKAGSSLVKHAEEILRKRGADMIWCNARTSASGYYRKLGFSEQGEVFDTPPVGPHILMYKRIT

SEQ ID NO: 908 - DNA, 441 bp, Artificial Sequence
  Synthetic nucleic acid sequence
  CDS (1)...(441): GAT25-14C12
atgatagaggtaaaaccgattaacgcagaggatacctatgaactaaggcatagagtcctcagaccaaaccagccgatagaagcgtgtatgtttgaaagcgatttaacgcgtggtgcatttcacttaggcggcttctacgggggcaaactggtttccgtcgcttcattccaccaggccgagcactcggaacttcaaggccagaaacagtaccagcttcgaggtgtggctaccttggaaggttatcgtgagcagaaggcgggttccagtctagttaaacacgctgaagaaattctgcgtaagaggggggcggacatgctttggtgtaatgcgcggacatccgcctcaggctactacagaaagttaggcttcagcgagcagggagaggtattcgacacgccgccagtaggacctcacatcctgatgtataaaaggatcacataa

SEQ ID NO: 909 - protein, 146 aa, Artificial Sequence
  25-14C12
MIEVKPINAEDTYELRHRVLRPNQPIEACMFESDLTRGAFHLGGFYGGKLVSVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 910 - DNA, 441 bp, Artificial Sequence
  Synthetic nucleic acid sequence
  CDS (1)...(441): GAT25-17F3
atgatagaggtaaaaccgattaacgcagaagatacctatgaactaaggcatagagtcctcagaccaaaccagccgatagaagcgtgtatgtttgatagcgatttaacgcgtggtgcatttcacttaggcggcttctacgggggcaaactgatttccgtcgcttcattccaccaggccgagcactcggaacttcaaggccagaaacagtatcagcttcgaggtgtggctaccttggaaggttatcgtgagcagaaggcgggaaccagtctagttaaacacgctgaagaaattctacgcaagaggggggcggacatgatttggtgtaatgcgcggacatcggcctcaggctactacagaaagttaggcttcagcgagcagggagaggtattcgacacgccgccagtaggacctcacgtcctgatgtataaaaggatcacataa

SEQ ID NO: 911 - protein, 146 aa, Artificial Sequence
  25-17F3
MIEVKPINAEDTYELRHRVLRPNQPIEACMFDSDLTRGAFHLGGFYGGKLISVASFHQAEHSELQGQKQYQLRGVATLEGYREQKAGTSLVKHAEEILRKRGADMIWCNARTSASGYYRKLGFSEQGEVFDTPPVGPHVLMYKRIT

SEQ ID NO: 912 - DNA, 441 bp, Artificial Sequence
  Synthetic nucleic acid sequence
  CDS (1)...(441): GAT25-19C8
atgatagaggtaaaaccgattaacgcagaagatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcaaggccagaaacagtatcagcttcgaggcgtggctaccttggaaggttatcgtgagcagaaggcgggttccagtctagtcaaacacgctgaagaaattctacgtaagaggggggtggacctactttggtgtaatgcgcggacatccgcctcaggctactacagaaagttaggcttcagcgagcagggagaggtattcgacacgccgccagtaggtcctcacatcctgatgtataaaaggatcacataa

SEQ ID NO: 913 - protein, 146 aa, Artificial Sequence
  25-19C8
MIEVKPINAEDTYDLRHRVLRPNQPIEACMFESDLTRSAFHLGGFYGGKLISVASFHQAEHSELQGQKQYQLRGVATLEGYREQKAGSSLVKHAEEILRKRGVDLLWCNARTSASGYYRKLGFSEQGEVFDTPPVGPHILMYKRIT

SEQ ID NO: 914 - DNA, 441 bp, Artificial Sequence
  Synthetic nucleic acid sequence
  CDS (1)...(441): GAT25-23C1
atgatagaggtaaaaccgattaacgcagaagatacctatgaactaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcacacggaacttcaaggccggaaacagtaccagcttcgaggtgtggctaccttggaaggttaccgtgagcagaaggcgggaaccagtctagttaaacacgctgaagaaattctacgtaagaggggggcggacatgctttggtgtaatgcgcggacatccgcctcaggctactacagaaagttaggcttcagcgagcagggagaggtattcgacacgccgccggtaggacctcacatcctgatgtataaaaggatcacataa

SEQ ID NO: 915 - protein, 146 aa, Artificial Sequence
  25-23C1
MIEVKPINAEDTYELRHRVLRPNQPIEACMFESDLTRGAFHLGGFYGGKLISVASFHQAEHTELQGRKQYQLRGVATLEGYREQKAGTSLVKHAEEILRKRGADMLWCNARTSASGYYRKLGFSEQGEVFDTPPVGPHILMYKRIT

SEQ ID NO: 916 - DNA, 441 bp, Artificial Sequence
  Synthetic nucleic acid sequence
  CDS (1)...(441): R12G1
atgatagaggtaaaaccgattaacgcagaggatacctatgacctaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcacactgaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 917 - protein, 146 aa, Artificial Sequence
  R12G1
MIEVKPINAEDTYDLRHRVLRPNQPIEACMFESDLTRGAFHLGGFYGGKLISVASFHQAEHTELQGKKQYQLRGVATLEGYREQKAGSSLVKHAEEILRKRGADMIWCNARTSASGYYRKLGFSEQGEVFDTPPVGPHILMYKRIT

SEQ ID NO: 918 - DNA, 441 bp, Artificial Sequence
  Synthetic nucleic acid sequence
  CDS (1)...(441): R12G2
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcacactgaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 919 - protein, 146 aa, Artificial Sequence
  R12G2
MIEVKPINAEDTYDLRHRVLRPNQPIEACMFESDLTRSAFHLGGFYGGKLISVASFHQAEHTELQGKKQYQLRGVATLEGYREQKAGSSLVKHAEEILRKRGADMIWCNARTSASGYYRKLGFSEQGEVFDTPPVGPHILMYKRIT

SEQ ID NO: 920 - DNA, 441 bp, Artificial Sequence
  Synthetic nucleic acid sequence
  CDS (1)...(441): R12G3
atgatagaggtaaaaccgattaacgcagaggatacctatgacctaaggcatagagtcctcagaccaaaccagccgatagaagcgtgtatgtttgataacgatttaacgcgtggtgcatttcacttaggcggcttctacgggggcaaactgatttccgtcgcttcattccaccaggccgagcactcggaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 921 - protein, 146 aa, Artificial Sequence
  R12G3
MIEVKPINAEDTYDLRHRVLRPNQPIEACMFDNDLTRGAFHLGGFYGGKLISVASFHQAEHSELQGKKQYQLRGVATLEGYREQKAGSSLVKHAEEILRKRGADMIWCNARTSASGYYRKLGFSEQGEVFDTPPVGPHILMYKRIT

SEQ ID NO: 922 - DNA, 441 bp, Artificial Sequence
  Synthetic nucleic acid sequence
  CDS (1)...(441): R12G4
atgatagaggtaaaaccgattaacgcagaggatacctatgaactaaggcatagagtcctcagaccaaaccagccgatagaagcgtgtatgtttgatagcgatttaacgcgtagtgcatttcacttaggcggcttctacgggggcaaactgatttccgtcgcttcattccaccaggccgagcactcggaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 923 - protein, 146 aa, Artificial Sequence
  R12G4
MIEVKPINAEDTYELRHRVLRPNQPIEACMFDSDLTRSAFHLGGFYGGKLISVASFHQAEHSELQGKKQYQLRGVATLEGYREQKAGSSLVKHAEEILRKRGADMIWCNARTSASGYYRKLGFSEQGEVFDTPPVGPHILMYKRIT

SEQ ID NO: 924 - DNA, 441 bp, Artificial Sequence
  Synthetic nucleic acid sequence
  CDS (1)...(441): R12G5
atgatagaggtaaaaccgattaacgcagaggatacctatgaactaaggcatagagtcctcagaccaaaccagccgatagaagcgtgtatgtttgatagcgatttaacgcgtggtgcatttcacttaggcggcttctacgggggcaaactgatttccgtcgcttcattccaccaggccgagcactcggaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 925 - protein, 146 aa, Artificial Sequence
  R12G5
MIEVKPINAEDTYELRHRVLRPNQPIEACMFDSDLTRGAFHLGGFYGGKLISVASFHQAEHSELQGKKQYQLRGVATLEGYREQKAGSSLVKHAEEILRKRGADMIWCNARTSASGYYRKLGFSEQGEVFDTPPVGPHILMYKRIT

SEQ ID NO: 926 - DNA, 441 bp, Artificial Sequence
  Synthetic nucleic acid sequence
  CDS (1)...(441): R12G6
atgatagaggtaaaaccgattaacgcagaggatacctatgacctaaggcatagagtcctcagaccaaaccagccgatagaagcgtgtatgtttgataacgatttaacgcgtagtgcatttcacttaggcggcttctacgggggcaaactgatttccgtcgcttcattccaccaggccgagcactcggaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 927 - protein, 146 aa, Artificial Sequence
  R12G6
MIEVKPINAEDTYDLRHRVLRPNQPIEACMFDNDLTRSAFHLGGFYGGKLISVASFHQAEHSELQGKKQYQLRGVATLEGYREQKAGSSLVKHAEEILRKRGADMIWCNARTSASGYYRKLGFSEQGEVFDTPPVGPHILMYKRIT

SEQ ID NO: 928 - DNA, 441 bp, Artificial Sequence
  Synthetic nucleic acid sequence
  CDS (1)...(441): R12G7
atgatagaggtaaaaccgattaacgcagaagatacctatgacctaaggcatagagtcctcagaccaaaccagccgatagaagcgtgtatgtttgataacgatttaatgcgtggtgcatttcacttaggcggcttccacgggggcaaactgatttccgtcgcttcattccaccaggccgagcacactgaacttcaaggccagaaacagtatcagcttcgaggtgtggctaccttggaaggttatcgtgagcagaaggcgggttccagtctagttaaacacgctgaagaaattctacgtaagaggggggcggacatgctttggtgtaatgcgcggacatccgcctcaggctactacagaaagttgggcttcagcgagcagggagaggtattcgacacgccgccggtaggacctcacatcctgatgtataaaaggatcacataa

SEQ ID NO: 929 - protein, 146 aa, Artificial Sequence
  R12G7
MIEVKPINAEDTYDLRHRVLRPNQPIEACMFDNDLMRGAFHLGGFHGGKLISVASFHQAEHTELQGQKQYQLRGVATLEGYREQKAGSSLVKHAEEILRKRGADMLWCNARTSASGYYRKLGFSEQGEVFDTPPVGPHILMYKRIT

SEQ ID NO: 930 - DNA, 441 bp, Artificial Sequence
  Synthetic nucleic acid sequence
  CDS (1)...(441): R12G8
atgatagaggtaaaaccgattaacgcagaagatacctatgacctaaggcatagagtcctcagaccaaaccagccgatagaagcgtgtatgtttgataacgatttaatgcgtagtgcatttcacttaggcggcttccacgggggcaaactgatttccgtcgcttcattccaccaggccgagcacactgaacttcaaggccagaaacagtatcagcttcgaggtgtggctaccttggaaggttatcgtgagcagaaggcgggttccagtctagttaaacacgctgaagaaattctacgtaagaggggggcggacatgctttggtgtaatgcgcggacatccgcctcaggctactacagaaagttgggcttcagcgagcagggagaggtattcgacacgccgccggtaggacctcacatcctgatgtataaaaggatcacataa

SEQ ID NO: 931 - protein, 146 aa, Artificial Sequence
  R12G8
MIEVKPINAEDTYDLRHRVLRPNQPIEACMFDNDLMRSAFHLGGFHGGKLISVASFHQAEHTELQGQKQYQLRGVATLEGYREQKAGSSLVKHAEEILRKRGADMLWCNARTSASGYYRKLGFSEQGEVFDTPPVGPHILMYKRIT

SEQ ID NO: 932 - DNA, 441 bp, Artificial Sequence
  Synthetic nucleic acid sequence GAT4604SR
  CDS (1)...(441): encodes 20-H812 (SEQ 739)
atgatagaggtgaaaccgattaacgcagaggatacctatgaactaaggcatagagtcctcagaccaaaccagccgatagaagcgtgtatctttgaaagcgatttaatgcgtggtgcatttcacttaggcggcttctacgggggcagactgatttccgtcgcttcattccaccaggccgagcactctgaacttcaaggccagaaacagtaccagcttcgaggtatggctaccttggaaggttatcgtgagcagaaggcgggttccagtctagttaaacacgctgaagaaattctacgtaagaggggggcggacctactttggtgtaatgcgaggacatccgcctcaggctactacaaaaagttaggcttcagcgagcagggagaggtattcgacacgccgccagtaggacctcacatcctgatgtataaaaggatcacataa

SEQ ID NO: 933 - DNA, 449 bp, Artificial Sequence
  Synthetic nucleic acid sequence GAT4609SR
  CDS (1)...(441): encodes 22-18C5 (SEQ 795)
atgatagaggtaaaaccgattaacgcagaggatacctatgacctaaggcatagagtcctcagaccaaaccagccgatagaagcgtgtatgtttgaaagcgatttaacgcgtggtgcatttcacttaggcggcttctacgggggcaaactgatttccgtcgcttcattccaccaggccgagcactctgaacttcaaggccagaaacagtatcagcttcgaggtgtggctaccttggaaggttatcgtgagcagaaggcgggaaccagtctagttaaacacgctgaagaaattctacgtaagaggggggtggacctactttggtgtaatgcgaggacatccgcctcaggctactacagaaagttaggcttcagcgagcagggagaggtattcgacacgccgccagtaggacctcacatcctgatgtataaaaggatcacataaggcgcgcc

SEQ ID NO: 934 - DNA, 449 bp, Artificial Sequence
  Synthetic nucleic acid sequence GAT4610R
  CDS (1)...(441): encodes 22-16D8 (SEQ 793)
atgatagaggtaaaaccgattaacgcagaggatacctatgaactaaggcatagagtcctcagaccaaaccagccgatagaagcgtgtatgtttgaaagcgatttactgcgtggtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggaaccagtctagttaaacacgctgaagaaattctacgtaagaggggggcggacatgctttggtgtaatgcgaggacatccgcctcaggctactacagaaagttaggctttagcgagcagggagaggtattcgacacgccgccagtaggacctcacatcctgatgtataaaaggatcacataaggcgcgcc

SEQ ID NO: 935 - DNA, 449 bp, Artificial Sequence
  Synthetic nucleic acid sequence GAT4611R
  CDS (1)...(441): encodes 22-15B4 (SEQ 789)
atgatagaggtaaaaccgattaacgcagaagatacctatgacctaaggcatagagtcctcagaccaaaccagccgatagaagcgtgtatgtttgatagcgatttaatgcgtagtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggtggacctactttggtgtaatgcgaggacatccgcctcaggctactacaaaaagttaggcttcagcgagcagggagaggtattcgacacgccgccagtaggacctcacatcctgatgtataaaaggatcacataaggcgcgcc

SEQ ID NO: 936 - DNA, 441 bp, Artificial Sequence
  Synthetic nucleic acid sequence GAT4614SR
  CDS (1)...(441): encodes 24-5H5 (SEQ 849)
atgatagaggtaaaaccgattaacgcagaagatacctatgacctaaggcatagagtcctcagaccaaaccagccgatagaagcgtgtatgtttgataacgatttaatgcgtagtgcatttcacttaggcggcttccacgggggcaaactgatttccgtcgcttcattccaccaggccgagcactctgaacttcaaggccagaaacagtatcagcttcgaggtgtggctaccttggaaggttatcgtgagcagaaggcgggttccagtctagttaaacacgctgaagaaattctacgtaagaggggggcggacatgctttggtgtaatgcgaggacatccgcctcaggctactacagaaagttgggcttcagcgagcagggagaggtattcgacacgccgccggtaggacctcacatcctgatgtataaaaggatcacataa

SEQ ID NO: 937 - DNA, 441 bp, Artificial Sequence
  Synthetic nucleic acid sequence GAT4614VSR
  CDS (1)...(441): encodes 24-5H5 (SEQ 849)
atgatagaggtgaaaccgattaacgcagaagatacctatgacctaaggcatagagtcctcagaccaaaccagccgatagaagcgtgtatgtttgataacgatttaatgcgtagtgcatttcacttaggcggcttccacgggggcaaactgatttccgtcgcttcattccaccaggccgagcactctgaacttcaaggccagaaacagtatcagcttcgaggtgtggctaccttggaaggttatcgtgagcagaaggcgggttccagtctagttaaacacgctgaagaaattctacgtaagaggggggcggacatgctttggtgtaatgcgaggacatccgcctcaggctactacagaaagttgggcttcagcgagcagggagaggtattcgacacgccgccggtaggacctcacatcctgatgtataaaaggatcacataa

SEQ ID NO: 938 - DNA, 441 bp, Artificial Sequence
  Synthetic nucleic acid sequence GAT4615R
  CDS (1)...(441): encodes 23-2H11 (SEQ 837)
atgatagaggtaaaaccgattaacgcagaggatacctatgacctaaggcatagagtcctcagaccaaaccagccgatagaagcgtgtatgtttgaaggcgatttaatgcgtggtgcatttcacttaggcggcttctacgggggcaaactgatttccgtcgcttcattccaccaggccgagcactcggaacttcaaggccagaaacagtaccagcttcgaggtgtggctaccttggaaggttatcgtgagcagaaggcgggttccagtctagttaaacatgctgaagaaattctacgcaagaggggggcggacctactttggtgtaatgcgaggacatccgcctcaggctactacagaaagttaggcttcagcgagcagggagaggtattcgacacgccgccagtaggacctcacatcctgatgtataaaaggatcacataa

SEQ ID NO: 939 - DNA, 441 bp, Artificial Sequence
  Synthetic nucleic acid sequence GAT4616R
  CDS (1)...(441): encodes 24-15C3 (SEQ 863)
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcagggccagaaacagtaccagcttcgaggtgtggctaccttggaaggttatcgtgagcagaaggcgggaaccagtctagttaaacacgctgaagaaattctacgtaagaggggggcggacctactttggtgtaatgcgaggacatccgcctcaggctactacagaaagttaggcttcagcgagcagggagaggtattcgacacgccgccagtaggacctcacatcctgatgtataaaaggatcacataa

SEQ ID NO: 940 - DNA, 441 bp, Artificial Sequence
  Synthetic nucleic acid sequence GAT4617R
  CDS (1)...(441): encodes 23-6H10 (SEQ 845)
atgatagaggtaaaaccgattaacgcagaggatacctatgaactaaggcatagagtcctcagaccaaaccagccgatagaagcgtgtatgtttgaaagcgatttaacgcgtggtgcatttcacctaggcggcttctacgggggcaaactgatttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggcggacctactttggtgtaatgcgaggacatccgcctcaggctactacagaaagttaggcttcagcgagcagggggaggtattcgacacgccgccagtaggacctcacatcctgatgtataaaaggatcacataa

SEQ ID NO: 941 - DNA, 441 bp, Artificial Sequence
  Synthetic nucleic acid sequence GAT4618SR
  CDS (1)...(441): encodes 25-8H7 (SEQ 907)
atgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactctgaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgaggacatctgcctcaggctactacagaaagttaggcttcagcgagcagggagaggtattcgacacgccgccagtaggacctcacatcctgatgtataaaaggatcacataa

SEQ ID NO: 942 - DNA, 441 bp, Artificial Sequence
  Synthetic nucleic acid sequence GAT4618VSR
  CDS (1)...(441): encodes 25-8H7 (SEQ 907)
atgatagaggtgaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactctgaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgaggacatctgcctcaggctactacagaaagttaggcttcagcgagcagggagaggtattcgacacgccgccagtaggacctcacatcctgatgtataaaaggatcacataa

SEQ ID NO: 943 - DNA, 441 bp, Artificial Sequence
  Synthetic nucleic acid sequence GAT4619SR
  CDS (1)...(441): encodes 25-19C8 (SEQ 913)
atgatagaggtaaaaccgattaacgcagaagatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactctgaacttcaaggccagaaacagtatcagcttcgaggcgtggctaccttggaaggttatcgtgagcagaaggcgggttccagtctagtcaaacacgctgaagaaattctacgtaagaggggggtggacctactttggtgtaatgcgaggacatccgcctcaggctactacagaaagttaggcttcagcgagcagggagaggtattcgacacgccgccagtaggtcctcacatcctgatgtataaaaggatcacataa

SEQ ID NO: 944 - DNA, 441 bp, Artificial Sequence
  Synthetic nucleic acid sequence GAT4619VSR
  CDS (1)...(441): encodes 25-19C8 (SEQ 913)
atgatagaggtgaaaccgattaacgcagaagatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactctgaacttcaaggccagaaacagtatcagcttcgaggcgtggctaccttggaaggttatcgtgagcagaaggcgggttccagtctagtcaaacacgctgaagaaattctacgtaagaggggggtggacctactttggtgtaatgcgaggacatccgcctcaggctactacagaaagttaggcttcagcgagcagggagaggtattcgacacgccgccagtaggtcctcacatcctgatgtataaaaggatcacataa

SEQ ID NO: 945 - DNA, 452 bp, Artificial Sequence
  Synthetic nucleic acid sequence GAT4611A
  CDS (1)...(444): encodes 22-15B4 M1MA
atggcgatagaggtaaaaccgattaacgcagaagatacctatgacctaaggcatagagtcctcagaccaaaccagccgatagaagcgtgtatgtttgatagcgatttaatgcgtagtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggtggacctactttggtgtaatgcgcggacatccgcctcaggctactacaaaaagttaggcttcagcgagcagggagaggtattcgacacgccgccagtaggacctcacatcctgatgtataaaaggatcacataaggcgcgcc

SEQ ID NO: 946 - protein, 147 aa, Artificial Sequence
  22-15B4 M1MA
MAIEVKPINAEDTYDLRHRVLRPNQPIEACMFDSDLMRSAFHLGGFYGGKLISVASFHQAEHTELQGQKQYQLRGVATLEGYREQKAGSSLVKHAEEILRKRGVDLLWCNARTSASGYYKKLGFSEQGEVFDTPPVGPHILMYKRIT

SEQ ID NO: 947 - DNA, 455 bp, Artificial Sequence
  Synthetic nucleic acid sequence GAT4611AA
  CDS (1)...(447): encodes 22-15B4 M1MAA
atggcggccatagaggtaaaaccgattaacgcagaagatacctatgacctaaggcatagagtcctcagaccaaaccagccgatagaagcgtgtatgtttgatagcgatttaatgcgtagtgcatttcacttaggcggcttctacgggggcaaactgatttccgtcgcttcattccaccaggccgagcacacggaacttcaaggccagaaacagtaccagcttcgaggtgtggctaccttggaaggttatcgtgagcagaaggcgggttccagtctagttaaacacgctgaagaaattctacgtaagaggggggtggacctactttggtgtaatgcgcggacatccgcctcaggctactacaaaaagttaggcttcagcgagcagggagaggtattcgacacgccgccagtaggacctcacatcctgatgtataaaaggatcacataaggcgcgcc

SEQ ID NO: 948 - protein, 148 aa, Artificial Sequence
  22-15B4 M1MAA
MAAIEVKPINAEDTYDLRHRVLRPNQPIEACMFDSDLMRSAFHLGGFYGGKLISVASFHQAEHTELQGQKQYQLRGVATLEGYREQKAGSSLVKHAEEILRKRGVDLLWCNARTSASGYYKKLGFSEQGEVFDTPPVGPHILMYKRIT

SEQ ID NO: 949 - DNA, 444 bp, Artificial Sequence
  Synthetic nucleic acid sequence GAT4618A
  CDS (1)...(444): encodes 25-8H7 M1MA
atggcgatagaggtaaaaccgattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactcggaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgcggacatctgcctcaggctactacagaaagttaggcttcagcgagcagggagaggtattcgacacgccgccagtaggacctcacatcctgatgtataaaaggatcacataa

SEQ ID NO: 950 - protein, 147 aa, Artificial Sequence
  25-8H7 M1MA
MAIEVKPINAEDTYDLRHRVLRPNQPIEACMFESDLTRSAFHLGGFYGGKLISVASFHQAEHSELQGKKQYQLRGVATLEGYREQKAGSSLVKHAEEILRKRGADMIWCNARTSASGYYRKLGFSEQGEVFDTPPVGPHILMYKRIT

SEQ ID NO: 951 - DNA, 444 bp, Artificial Sequence
  Synthetic nucleic acid sequence GAT4620
  CDS (1)...(444): encodes 25-8H7 M1MA (SEQ ID NO:950)
atggctattgaggttaaacctattaacgcagaggatacctatgacctaaggcatagagtcctcagaccaaaccagccgatagaagcgtgtatgtttgaaagcgatttaacgcgtagtgcatttcacttaggcggcttctacgggggcaaactgatttccgtcgcttcattccaccaggccgagcactctgaacttcaaggcaagaaacagtaccagcttcgaggtgtggctaccttggaaggttatcgtgagcagaaggcgggttccagtctagttaaacacgctgaagaaattctacgtaagaggggggcggacatgatttggtgtaatgcgaggacatctgcctcaggctactacagaaagttaggcttcagcgagcagggagaggtattcgacacgccgccagtaggacctcacatcctgatgtataaaaggatcacataa

SEQ ID NO: 952 - DNA, 444 bp, Artificial Sequence
  Synthetic nucleic acid sequence GAT4621
  CDS (1)...(444): encodes 25-8H7 M1MA (SEQ ID NO:950)
atggctattgaggttaagcctatcaacgcagaggatacctatgaccttaggcatagagtgctcagaccaaaccagcctatcgaagcctgcatgtttgagtctgaccttactaggagtgcatttcaccttggtggattctacggaggtaaactgatttccgtggcttcattccaccaagctgagcactctgaacttcaaggtaagaagcagtaccagcttagaggtgtggctaccttggaaggttatagagagcagaaggctggttccagtctcgtgaaacacgctgaagagattctcagaaagagaggtgctgacatgatctggtgtaatgccaggacatctgcttcaggatactacaggaagttgggattcagtgagcaaggagaggtgttcgatactcctccagttggacctcacatcctgatgtataagaggatcacataa

SEQ ID NO: 953 - protein, 146 aa, Artificial Sequence
  fil 3 con
  VARIANT 4: Val or Ile
  VARIANT 14: Asp or Glu
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYXLRHXXLRPNQPXEXCXXXXDLXRXAFHLGGXYXGXLXSXASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

SEQ ID NO: 954 - protein, 146 aa, Artificial Sequence
  con alt a
  VARIANT 14: Asp or Glu
  VARIANT 32: Glu or Asp
  VARIANT 33: Ser or Asn
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys
  VARIANT 88: Ser or Thr
  VARIANT 103: Ala or Val
  VARIANT 105: Met or Leu
  VARIANT 106: Ile or Leu
  VARIANT 119: Arg or Lys
  VARIANT 139: Ile or Val
MIEVKPINAEDTYXLRHRVLRPNQPIEACMFXXDLMRXAFHLGGFXGGKLXSVASFHXAXHXELQGXKQYQLRGVATLEGYREQKAGXSLVKHAEEILRKRGXDXXWCNARTSASGYYXKLGFSEQGEVFDTPPVGPHXLMYKRIT

SEQ ID NO: 955 - protein, 146 aa, Artificial Sequence
  con alt b
  VARIANT 14: Asp or Glu
  VARIANT 32: Glu or Asp
  VARIANT 33: Ser or Asn
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys
  VARIANT 88: Ser or Thr
  VARIANT 103: Ala or Val
  VARIANT 106: Ile or Leu
  VARIANT 119: Arg or Lys
  VARIANT 139: Ile or Val
MIEVKPINAEDTYXLRHRVLRPNQPIEACMFXXDLTRXAFHLGGFXGGKLXSVASFHXAXHXELQGXKQYQLRGVATLEGYREQKAGXSLVKHAEEILRKRGXDMXWCNARTSASGYYXKLGFSEQGEVFDTPPVGPHXLMYKRIT

SEQ ID NO: 956 - protein, 146 aa, Artificial Sequence
  con alt c
MIEVKPINAEDTYDLRHRVLRPNQPIEACMFESDLTRGAFHLGGFYGGKLISVASFHQAEHSELQGQKQYQLRGVATLEGYREQKAGSSLVKHAEEILRKRGADMLWCNARTSASGYYRKLGFSEQGEVFDTPPVGPHILMYKRIT

SEQ ID NO: 957 - protein, 146 aa, Artificial Sequence
  con alt e
  VARIANT 14: Asp or Glu
  VARIANT 33: Gly or Ser or Asn
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys or Arg
  VARIANT 88: Ser or Thr
  VARIANT 103: Ala or Val
  VARIANT 105: Leu or Met
  VARIANT 106: Ile or Leu
  VARIANT 119: Arg or Lys
  VARIANT 139: Ile or Val
MIEVKPINAEDTYXLRHRVLRPNQPIEACMFDXDLTRXAFHLGGFXGGKLXSVASFHXAXHXELQGXKQYQLRGVATLEGYREQKAGXSLVKHAEEILRKRGXDXXWCNARTSASGYYXKLGFSEQGEVFDTPPVGPHXLMYKRIT

SEQ ID NO: 958 - protein, 146 aa, Artificial Sequence
  con alt f
  VARIANT 32: Glu or Asp
  VARIANT 33: Gly or Ser or Asn
  VARIANT 36: Thr or Met
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys or Arg
  VARIANT 88: Ser or Thr
  VARIANT 103: Ala or Val
  VARIANT 106: Ile or Leu
  VARIANT 119: Arg or Lys
  VARIANT 139: Ile or Val
MIEVKPINAEDTYELRHRVLRPNQPIEACMFXXDLXRXAFHLGGFXGGKLXSVASFHXAXHXELQGXKQYQLRGVATLEGYREQKAGXSLVKHAEEILRKRGXDLXWCNARTSASGYYXKLGFSEQGEVFDTPPVGPHXLMYKRIT

SEQ ID NO: 959 - protein, 146 aa, Artificial Sequence
  con alt g
  VARIANT 33: Gly or Ser or Asn
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys or Arg
  VARIANT 88: Ser or Thr
  VARIANT 103: Ala or Val
  VARIANT 105: Leu or Met
  VARIANT 106: Ile or Leu
  VARIANT 119: Arg or Lys
  VARIANT 139: Ile or Val
MIEVKPINAEDTYELRHRVLRPNQPIEACMFDXDLMRXAFHLGGFXGGKLXSVASFHXAXHXELQGXKQYQLRGVATLEGYREQKAGXSLVKHAEEILRKRGXDXXWCNARTSASGYYXKLGFSEQGEVFDTPPVGPHXLMYKRIT

SEQ ID NO: 960 - protein, 146 aa, Artificial Sequence
  con alt h
  VARIANT 14: Asp or Glu
  VARIANT 32: Glu or Asp
  VARIANT 33: Gly or Ser or Asn
  VARIANT 36: Thr or Met
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys or Arg
  VARIANT 88: Ser or Thr
  VARIANT 103: Ala or Val
  VARIANT 105: Leu or Met
  VARIANT 106: Ile or Leu
  VARIANT 119: Arg or Lys
  VARIANT 139: Ile or Val
MIEVKPINAEDTYXLRHRVLRPNQPIEACMFXXDLXRSAFHLGGFXGGKLXSVASFHXAXHXELQGXKQYQLRGVATLEGYREQKAGXSLVKHAEEILRKRGXDXXWCNARTSASGYYXKLGFSEQGEVFDTPPVGPHXLMYKRIT

SEQ ID NO: 961 - protein, 146 aa, Artificial Sequence
  con alt i
  VARIANT 14: Asp or Glu
  VARIANT 36: Thr or Met
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys or Arg
  VARIANT 88: Ser or Thr
  VARIANT 103: Ala or Val
  VARIANT 105: Leu or Met
  VARIANT 106: Ile or Leu
  VARIANT 119: Arg or Lys
  VARIANT 139: Ile or Val
MIEVKPINAEDTYXLRHRVLRPNQPIEACMFDNDLXRXAFHLGGFXGGKLXSVASFHXAXHXELQGXKQYQLRGVATLEGYREQKAGXSLVKHAEEILRKRGXDXXWCNARTSASGYYXKLGFSEQGEVFDTPPVGPHXLMYKRIT

SEQ ID NO: 962 - protein, 146 aa, Artificial Sequence
  con alt j
  VARIANT 14: Asp or Glu
  VARIANT 32: Glu or Asp
  VARIANT 33: Gly or Ser or Asn
  VARIANT 36: Thr or Met
  VARIANT 38: Gly or Ser
  VARIANT 46: His or Tyr
  VARIANT 51: Ile or Val
  VARIANT 58: Gln or Arg
  VARIANT 60: Glu or Gly
  VARIANT 62: Ser or Thr
  VARIANT 67: Gln or Lys or Arg
  VARIANT 88: Ser or Thr
  VARIANT 103: Ala or Val
  VARIANT 106: Ile or Leu
  VARIANT 119: Arg or Lys
  VARIANT 139: Ile or Val
MIEVKPINAEDTYXLRHRVLRPNQPIEACMFXXDLXRXAFHLGGFXGGKLXSVASFHXAXHXELQGXKQYQLRGVATLEGYREQKAGXSLVKHAEEILRKRGXDMXWCNARTSASGYYXKLGFSEQGEVFDTPPVGPHXLMYKRIT

SEQ ID NO: 963 - protein, 146 aa, Artificial Sequence
  con alt k
  VARIANT 4: Val or Ile
  VARIANT 18: Arg or Lys
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYDLRHXVLRPNQPXEXCXXXXDLMRXAFHLGGXYXGXLXSXASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

SEQ ID NO: 964 - protein, 146 aa, Artificial Sequence
  con alt l
  VARIANT 4: Val or Ile
  VARIANT 14: Asp or Glu
  VARIANT 18: Arg or Lys
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYXLRHXVLRPNQPXEXCXXXXDLMRXAFHLGGXYXGXLXSVASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

SEQ ID NO: 965 - protein, 146 aa, Artificial Sequence
  con alt d
  VARIANT 14: Asp or Glu
  VARIANT 32: Glu or Asp
  VARIANT 33: Ser or Asn or Gly
  VARIANT 36: Thr or Met
  VARIANT 46: His or Tyr
  VARIANT 51: Ile or Val
  VARIANT 58: Gln or Arg
  VARIANT 60: Glu or Gly
  VARIANT 67: Gln or Lys or Arg
  VARIANT 103: Ala or Val
  VARIANT 105: Met or Leu
  VARIANT 106: Ile or Leu
  VARIANT 119: Arg or Lys
  VARIANT 139: Ile or Val
MIEVKPINAEDTYXLRHRVLRPNQPIEACMFXXDLXRXAFHLGGFXGGKLXSVASFHXAXHTELQGXKQYQLRGVATLEGYREQKAGSSLVKHAEEILRKRGXDXXWCNARTSASGYYXKLGFSEQGEVFDTPPVGPHXLMYKRIT

SEQ ID NO: 966 - protein, 146 aa, Artificial Sequence
  con alt n
  VARIANT 4: Val or Ile
  VARIANT 14: Asp or Glu
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYXLRHXXLRPNQPXEXCXXXXDLXRXAFHLGGXYXGXLXSXASFHXAXHXXXQGXKQYQXRGXATLEGYRXQKAGTXLXXHAEEIXRKRGXDXXWCNARTSASGXYXKLGFSEQGXXFXTPPXGPHXXMYKRXT

SEQ ID NO: 967 - protein, 146 aa, Artificial Sequence
  con alt o
  VARIANT 4: Val or Ile
  VARIANT 14: Asp or Glu
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 128: Glu or Asp
  VARIANT 129: Val or Ile
  VARIANT 135: Val or Ala
  VARIANT 139: Ile or Val
  VARIANT 140: Leu or Met
  VARIANT 145: Ile or Leu
MIEXKPINAEDTYXLRHXXLRPNQPXEXCXXXXDLXRXAFHLGGXYXGXLXSXASFHXAXHXXXQGXKQYQXRGXATLEGYRXQKAGXXLXXHAEEIXRKRGXDXXWCNARTSASGXYRKLGFSEQGXXFDTPPXGPHXXMYKRXT

SEQ ID NO: 968 - protein, 146 aa, Artificial Sequence
  con alt p
  VARIANT 4: Val or Ile
  VARIANT 14: Asp or Glu
  VARIANT 18: Arg or Lys
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYXLRHXVLRPNQPXEXCXXXXDLXRXAFHLGGXYXGXLXSXASFHXAXHXXXQGXKQYQXRGVATLEGYRXQKAGXXLXXHAEEIXRKRGXDXXWCNARTSASGXYXKLGFSEQGXXFXTPPXGPHXXMYKRXT

SEQ ID NO: 969 - protein, 146 aa, Artificial Sequence
  con alt q
  VARIANT 4: Val or Ile
  VARIANT 14: Asp or Glu
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYXLRHXXLRPNQPXEXCXXXXDLXRXAFHLGGXYXGRLXSXASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

SEQ ID NO: 970 - protein, 146 aa, Artificial Sequence
  con alt r
  VARIANT 4: Val or Ile
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYDLRHXXLRPNQPXEXCXXXXDLXRXAFHLGGXYXGXLXSVASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

SEQ ID NO: 971 - protein, 146 aa, Artificial Sequence
  con alt s
  VARIANT 4: Val or Ile
  VARIANT 14: Asp or Glu
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYXLRHXXLRPNQPXEXCXXXXDLMRXAFHLGGXYXGXLXSVASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

SEQ ID NO: 972 - protein, 146 aa, Artificial Sequence
  con alt t
  VARIANT 4: Val or Ile
  VARIANT 18: Arg or Lys
  VARIANT 19: Val or Ile
  VARIANT 26: Ile or Leu or Val
  VARIANT 28: Ala or Val
  VARIANT 30: Met or Ile
  VARIANT 31: Phe or Tyr
  VARIANT 32: Glu or Asp
  VARIANT 33: Ser or Asn
  VARIANT 36: Thr or Met or Leu
  VARIANT 38: Gly or Ser
  VARIANT 45: Phe or Tyr
  VARIANT 47: Gly or Arg
  VARIANT 49: Lys or Arg
  VARIANT 51: Ile or Val
  VARIANT 53: Val or Ile
  VARIANT 58: Gln or Arg
  VARIANT 60: Glu or Gly
  VARIANT 62: Ser or Thr
  VARIANT 63: Glu or Asp
  VARIANT 64: Leu or Ile
  VARIANT 67: Gln or Lys or Arg
  VARIANT 72: Leu or Ile
  VARIANT 75: Val or Met
  VARIANT 83: Asp or Glu
  VARIANT 88: Ser or Thr
  VARIANT 89: Ser or Thr
  VARIANT 91: Val or Ile or Leu
  VARIANT 92: Lys or Arg
  VARIANT 98: Leu or Ile
  VARIANT 103: Ala or Val
  VARIANT 105: Met or Leu or Ile
  VARIANT 106: Ile or Leu
  VARIANT 117: Tyr or Phe
  VARIANT 119: Arg or Lys
  VARIANT 128: Glu or Asp
  VARIANT 129: Val or Ile
  VARIANT 131: Asp or Glu
  VARIANT 135: Val or Ala
  VARIANT 139: Ile or Val
  VARIANT 140: Leu or Met
  VARIANT 145: Ile or Leu
MIEXKPINAEDTYDLRHXXLRPNQPXEXCXXXXDLXRXAFHLGGXYXGXLXSXASFHXAXHXXXQGXKQYQXRGXATLEGYRXQKAGXXLXXHAEEIXRKRGXDXXWCNARTSASGXYXKLGFSEQGXXFXTPPXGPHXXMYKRXT

What is claimed is:

1. An isolated or recombinant polynucleotide comprising a nucleotide sequence encoding a polypeptide comprising an amino acid sequence that is at least 97% identical to SEQ ID NO:919, wherein said polypeptide has glyphosate-N-acetyltransferase activity, wherein percent identity is calculated using ClustalW analysis (version W 1.8) using default parameters: Gap Open penalty of 10, gap extension penalty of 0.10, protein weight matrix: gonnet series; DNA weight matrix: IUB; toggle slow/fast pairwise alignments SLOW or FULL alignments.

2. The isolated or recombinant polynucleotide of claim 1, said nucleotide sequence comprises SEQ ID NO: 918.

3. The isolated or recombinant polynucleotide of claim 1, wherein a polypeptide encoded by said polynucleotide has glyphosate-N-acyltransferase activity.

4. The isolated or recombinant polynucleotide of claim 1, wherein the polypeptide catalyzes the acetylation of glyphosate with a $k_{cat}/K_m$ of at least 10 mM$^{-1}$min$^{-1}$ for glyphosate.

5. The isolated or recombinant polynucleotide of claim 1, wherein the polypeptide catalyzes the acetylation of aminomethylphosphonic acid.

6. A nucleic acid construct comprising an isolated or recombinant polynucleotide comprising a nucleotide sequence encoding a polypeptide comprising an amino acid sequence that is at least 97% identical to SEQ ID NO:919, wherein said polypeptide has glynhosate-N-acetyltransferase activity, wherein percent identity is calculated using Clustal W analysis (version W 1.8) using default parameters: Gap Onen penalty of 10, gap extension penalty of 0.10, protein weight matrix: gonnet series; DNA weight matrix: IUB; toggle slow/fast pairwise alignments-SLOW or FULL alignments.

7. The nucleic acid construct of claim 6, comprising a promoter operably linked to the isolated or recombinant polynucleotide, wherein the promoter is heterologous with respect to said polynucleotide and effective to cause sufficient expression of the encoded polypeptide to enhance the glyphosate tolerance of a plant cell transformed with said nucleic acid construct.

8. The nucleic acid construct of claim 7, wherein the isolated or recombinant polynucleotide functions as a selectable marker.

9. A vector comprising a nucleic acid construct comprising an isolated or recombinant polynucleotide comprising a nucleotide sequence encoding a polypeptide comprising an amino acid sequence that is at least 97% identical to SEQ ID NO:919, wherein said polypeptide has glyphosate-N-acetyltransferase activity, wherein percent identity is calculated using Clustal W analysis (version W 1.8) using default parameters: Gap Open penalty of 10, gap extension penalty of 0.10, protein weight matrix: gonnet series; DNA weight matrix: IUB; toggle slow/fast pairwise alignments-SLOW or FULL alignments.

10. The vector of claim 9 further comprising a second polynucleotide sequence encoding a second polypeptide that confers a detectable phenotypic trait upon a cell or organism expressing the second polypeptide at an effective level.

11. The vector of claim 10, wherein the detectable phenotypic trait functions as selectable marker.

12. The vector of claim 10, wherein the detectable phenotypic trait is selected from the group consisting of herbicide resistance and a visible marker.

13. The vector of claim 9, wherein the vector further comprises a T-DNA sequence.

14. The vector of claim 9, wherein the isolated or recombinant polynucleotide is operably linked to a regulatory sequence.

15. The vector of claim 9, wherein the vector is a plant transformation vector.

16. The isolated or recombinant polynucleotide of claim 1, wherein said nucleotide sequence encodes an amino acid sequence as set forth in SEQ ID NO: 950.

* * * * *